US008227188B2

(12) United States Patent
de Fougerolles et al.

(10) Patent No.: US 8,227,188 B2
(45) Date of Patent: Jul. 24, 2012

(54) ENHANCEMENT OF INFLUENZA GENE EXPRESSION

(75) Inventors: Antonin de Fougerolles, Brookline, MA (US); Tatiana Novobrantseva, Quincy, MA (US); Pamela Tan, Kulmbach (DE); Anke Geicke, Bayreuth (DE); Rachel Meyers, Newton, MA (US)

(73) Assignee: Alnylam Pharmaceuticals, Inc., Cambridge, MA (US)

(*) Notice: Subject to any disclaimer, the term of this patent is extended or adjusted under 35 U.S.C. 154(b) by 0 days.

(21) Appl. No.: 12/875,695

(22) Filed: Sep. 3, 2010

(65) Prior Publication Data

US 2011/0033859 A1 Feb. 10, 2011

Related U.S. Application Data

(63) Continuation of application No. 11/555,555, filed on Nov. 1, 2006, now abandoned.

(60) Provisional application No. 60/799,000, filed on May 9, 2006, provisional application No. 60/748,317, filed on Dec. 7, 2005, provisional application No. 60/732,243, filed on Nov. 1, 2005.

(51) Int. Cl.
*C12Q 1/68* (2006.01)

(52) U.S. Cl. ........... 435/6; 435/325; 435/375; 536/24.5; 536/24.31

(58) Field of Classification Search ........................ None
See application file for complete search history.

(56) References Cited

U.S. PATENT DOCUMENTS

| | | | |
|---|---|---|---|
| 4,501,729 | A | 2/1985 | Boucher et al. |
| 5,264,221 | A | 11/1993 | Tagawa et al. |
| 5,328,470 | A | 7/1994 | Nabel et al. |
| 5,580,767 | A | 12/1996 | Cowsert et al. |
| 5,665,710 | A | 9/1997 | Rahman et al. |
| 5,705,188 | A | 1/1998 | Junichi et al. |
| 5,756,353 | A | 5/1998 | Debs |
| 5,858,784 | A | 1/1999 | Debs et al. |
| 5,970,793 | A | 10/1999 | Nakajima |
| 6,071,497 | A | 6/2000 | Steiner et al. |
| 6,107,094 | A | 8/2000 | Crooke |
| 6,294,153 | B1 | 9/2001 | Modi |
| 6,344,194 | B1 | 2/2002 | Sene et al. |
| 6,747,014 | B2 | 6/2004 | Teng et al. |
| 6,803,198 | B2 | 10/2004 | Cook et al. |
| 6,887,906 | B1 | 5/2005 | Teng et al. |
| 7,199,109 | B2 | 4/2007 | Pal et al. |
| 2003/0087851 | A1 | 5/2003 | Takaku et al. |
| 2004/0029251 | A1 | 2/2004 | Hoffman et al. |
| 2004/0242518 | A1 | 12/2004 | Chen et al. |
| 2005/0008617 | A1 | 1/2005 | Chen et al. |
| 2005/0107325 | A1 | 5/2005 | Manoharan et al. |
| 2006/0035254 | A1 | 2/2006 | Manoharan et al. |
| 2006/0084620 | A1 | 4/2006 | McCray et al. |
| 2006/0148747 | A1 | 7/2006 | Stein et al. |
| 2006/0160759 | A1 | 7/2006 | Chen et al. |
| 2007/0099858 | A1 | 5/2007 | Jadhav et al. |

FOREIGN PATENT DOCUMENTS

| | | | |
|---|---|---|---|
| WO | 9203454 | A1 | 3/1992 |
| WO | WO-94-23028 | A2 | 10/1994 |
| WO | WO-96-40062 | A1 | 12/1996 |
| WO | WO-97-04787 | A1 | 2/1997 |
| WO | WO-97-30731 | A2 | 8/1997 |
| WO | WO-98-10796 | A1 | 3/1998 |
| WO | WO-98-31346 | A1 | 7/1998 |
| WO | WO-00-27359 | A1 | 5/2000 |
| WO | WO-00-50050 | A1 | 8/2000 |
| WO | WO-00-66206 | A2 | 11/2000 |
| WO | WO-01-54664 | A1 | 8/2001 |
| WO | WO-01-60420 | A1 | 8/2001 |
| WO | WO-02-053190 | A2 | 7/2002 |
| WO | WO-02-060412 | | 8/2002 |
| WO | WO-02-066078 | A2 | 8/2002 |
| WO | WO-2004-028471 | A2 | 4/2004 |
| WO | WO-2004-064737 | A2 | 8/2004 |
| WO | WO-2004-080406 | A2 | 9/2004 |
| WO | WO-2004-094345 | A2 | 11/2004 |
| WO | WO-2004-094595 | A2 | 11/2004 |
| WO | WO-2005-015481 | A1 | 2/2005 |
| WO | WO-2005-018931 | A1 | 3/2005 |
| WO | WO-2007-017759 | A2 | 2/2007 |

OTHER PUBLICATIONS

Novina et al. Nature 2004; 430: 161-164.*
Ge, Q., et al.; "Use of siRNAs to Prevent and Treat Influenza Virus Infection"; Virus Research, Amsterdam, NL LNKD-DOI:10.1016/J. Virusres2004.01.013; vol. 102, Jan. 1, 2004, pp. 37-42.
Gorman, O.T., et al.; "Evolution of the Nucleoprotein Gene of Influenza A Virus"; Journal of Virology; vol. 64, No. 4, Apr. 1990, pp. 1487-1497.
Wang et al., "Plasmid DNA Adsorbed to pH-Sensitive Liposomes Efficiently Transforms the Target Cells", Biochemical and Biophysical Research Communications, 147(3):980-985 (1987).
Pearson et al., "Improved tools for biological sequence comparison", Proc. Natl. Acad. Sci. USA., 85:2444-2448 (1988).
Castrucci et al., "Attenuation of Influenza A Viruse by Insertion of a Foreign Epitope into the Neuraminidase", Journal of Virology, 66(8):4647-4653 (1992).
Manche et al., "Interactions between Double-Stranded RNA Regulators and the Protein Kinase DAI", Molecular and Cellular Biology, 12(11): 5238-5248 (1992).
Zhou et al., "Targeted delivery of DNA by liposomes and polymers", Journal of Controlled Release, 19:269-274 (1992).
Manoharan, M. et al., "Chemical Modifications to Improve Uptake and Bioavailability of Antisense Oligonucleotides", Annals of the New York Academy of Sciences, 660(1): 306-309 (1992).
Lee et al., "The Interferon-Induced Double-Stranded RNA-Activated Protein Kinase Induces Apoptosis", Virology, 199: 491-496 (1994).
Chen et al., "Gene therapy for brain tumors: Regression of experimental gliomas by adenovirus-mediated gene transfer in vivo", Proc. Natl. Acad. Sci. USA, 91:3054-3057 (1994).

(Continued)

*Primary Examiner* — Kimberly Chong
(74) *Attorney, Agent, or Firm* — DT Ward, P.C.

(57) ABSTRACT

The invention relates to compositions and methods for modulating the expression of influenza viral genes, and more particularly to the downregulation of influenza viral genes by chemically modified oligonucleotides.

19 Claims, 3 Drawing Sheets

OTHER PUBLICATIONS

Limbach et al., "Summary: The Modified Nucleosides of RNA", Nucleic Acids Research, 22:2183-2196 (1994).
Thompson et al., "Clustal W: improving the sensitivity of progressive multiple sequence alignment through sequence weighting, position-specific gap penalties and weight matrix choice", Nucleic Acids Res., 22(22):4673-80 (1994).
Miyao et al., "Stability and Pharmacokinetic Characteristics of Oligonucleotides Modified at Terminal Linkages in Mice", Antisense Research and Development 5:115-121 (1995).
Takakura et al., "Uptake Characteristics of Oligonucleotides in the Isolated Rat Liver Perfusion System", Antisense & Nucleic Acid Drug Development, 6:177-183 (1996).
Alahari, S. K. et al., "Inhibition of Expression of the Multidrug Resistance-Associated P-Glycoprotein by Phosphorothioate and 5' Cholesterol-Conjugated Phosphorothioate Antisense Oligonucleotides", Molecular Pharmacology, 50(4): 808-819 (1996).
Hatta, T. et al., "Inhibition of Influenza Virus RNA Polymerase and Nucleoprotein Genes Expression by Unmodified Phosphorothioated, and Liposomally Encapsulated Oligonucleotides", Biochem. & Biophys. Research Comm., 223(2): 341-346 (1996).
Castelli et al., "A Study of the Interferon Antiviral Mechanism: Apoptosis Activation by the 2-5A System", The Journal of Experimental Medicine, 186(6): 967-972 (1997).
Fire et al., "Potent and specific genetic interference by Double-Stranded RNA in *Caenorhabditis elegans*", Nature, 391:806-811 (1998).
Abe, T. et al., "Specific inhibition of influenza virus RNA polymerase and nucleoprotein gene expression by liposomally encapsulated antisense phosphorothioate oligonucleotides in MDCK cells", Antiviral Chem. & Chemotherapy, 9(3): 253-262 (1998).
Hatta, T. et al., "Inhibition of Influenza Virus RNA Polymerase by 5'-Capped Short RNA Fragments", Biochem. & Biophys. Research Comm., 249(1): 103-106 (1998).
Hall, "BioEdit: a user-friendly biological sequence alignment editor and analysis program for Windows 95/98/NT", Nucleic Acids Symposium Series, Oxford Univ. Press, No. 41, 95-98 (1999).
Agrawal, S., "Importance of nucleotide sequence and chemical modifications of antisense oligonucleotides", Biochimica et Biophysica Acta, 1489(1): 53-68 (1999).
Prakash, T.P. et al., "Zwitterionic oligonucleotides with 2'-0-[3-(N,N-dimethylamino)propyl]-RNA modification: synthesis and properties", Tetrahedron Letters, 41(25): 4855-4859 (2000).
Sidwell and Smee, "In vitro and in vivo assay systems for study of influenza virus inhibitors", Antiviral Research, 48:1-16 (2000).
Templin et al., "Pharmaocokinetic and Toxicity Profile of a Phosphorothioate Oligonucleotide Following Inhalation Delivery to Lung in Mice", Antisense and Nucleic Acid Drug Development, 10: 359-368 (2000).
Elbashir et al., "RNA interference is mediated by 21- and 22-nucleotide RNAs", Genes & Development, 15:188-200 (2001).
Julkunen et al., "Molecular pathogenesis of influenza A virus infection and virus-induced regulation of cytokine gene expression", Cytokine & Growth Factor Reviews, 12:171-180 (2001).
Sandrasagra et al., "RASONs: a novel antisense oligonucleotide therapeutic approach for asthma", Expert. Opin. Biol., 1(6):979-983 (2001).
Sandrasagra et al., "Discovery and development of respirable antisense therapeutics for asthma", Antisense & Nucleic Acid Drug Development, 12:177-181 (2002).
Prakash, T.P. et al., "Synthesis of 2'-O-[2-[(N,N-Dimethylamino)oxy]ethyl] Modified Nucleosides and Oligonucleotides", J. Org. Chem., 67(2): 357-369 (2002).
Holen et al., "Positional effects of short interfering RNAs targeting the human coagulation trigger Tissue Factor", Nucleic Acids Research, 30(8): 1757-1766, Oxford University Press (2002).
Yang et al., "Short RNA duplexes produced by hydrolysis with *Escherichia coli* RNase III mediate effective RNA interference in mammalian cells", PNAS, 99(15): 9942-9947 (2002).
Ge, Q. et al., "RNA interference of influenza virus production by directly targeting mRNA for degradation and indirectly inhibiting all viral RNA transcription", Proc. Natl. Acad. Sci., USA, 100 (5):2718-2723 (2003).
Kurreck, J., "Antisense technologies: Improvement through novel chemical modifications," Eur. J. Biochem. 270(8): 1628-1644 (2003).
Scherer et al., Approaches for the sequence-specific knockdown of mRNA, 21(12): 1457-1465 (2003).
Novina et al., "The RNAi Revolution", Nature, 430:161-164 (2004).
Zhang et al., "Targeted gene silencing by small interfering RNA-b", Current Pharmaceutical Biotechnology, reviews, vol. 5, p. 1-7 (2004).
Tompkins, S.M. et al., "Protection against lethal influenza virus challenge by RNA interference in vivo", Proc. Natl. Acad. Sci., USA, 101 (23):8682-8686 (2004).
Haley and Zamore, "Kinetic analysis of the RNAi enzyme complex", Nature Structural & Molecular Biology, 11(7):599-606 (2004).
Ge, Q. et al., "Inhibition of influenza virus production in virus-infected mice by RNA interference", Proc. Natl. Acad. Sci., USA, 101 (23):8676-8681 (2004).
Zheng et al., "Activation of the protein kinase PKR by short double-stranded RNAs with single-stranded tails", RNA, 10: 1934-1945 (2004).
Heidel et al., "Lack of interferon response in animals to naked siRNAs", Nature Biotechnology, 22(12): 1579-1582 (2004).
Mahato et al., "Modulation of gene expression by antisense and antigene oligodeoxynucleotides and small interfering RNA", Expert Opinion on Drug Delivery, vol. 2(1): 3-28, Ashley Publications, Ltd., London (2005).
Sandy et al., "Mammalian RNAi: A practical guide", BioTechniques, 39:215-224 (2005).
Chen, X. et al., "Chemical modification of gene silencing oligonucleotides for drug discovery and development", Drug Discovery Today, 10(8): 587-593, Apr. 2005.
Byrom et al., "Inducing RNAi with siRNA Cocktails Generated by RNase III", [online] http://www.ambion.com/techlib/tn/101/4.html (2006).
Supplementary Partial European Search Report dated Jun. 4, 2009 for European Patent Application No. 06836768.9. Applicant: Alnylam Pharmaceuticals, Inc.

* cited by examiner

ENHANCEMENT OF INFLUENZA GENE EXPRESSION

CROSS-REFERENCE TO RELATED APPLICATIONS

This application is a continuation application and claims priority to U.S. application Ser. No. 11/555,555 filed Nov. 1, 2006 which claims priority to U.S. application Ser. No. 60/732,243, filed Nov. 1, 2005; U.S. Ser. No. 60/748,317, filed Dec. 7, 2005; and U.S. Ser. No. 60/799,000, filed May 9, 2006. The contents of each of these provisional applications are hereby incorporated by reference in their entirety.

Sequence Listing

The instant application contains a Sequence Listing which has been submitted in ASCII format via EFS-Web and is hereby incorporated by reference in its entirety. Said ASCII copy, created on Oct. 15, 2010, is named 20021002.txt and is 779,363 bytes in size.

TECHNICAL FIELD

The invention relates to the field of influenza viral therapy and compositions and methods for modulating viral replication, and more particularly to the down-regulation of a gene(s) of an influenza virus by oligonucleotides via RNA interference which are administered locally to the lungs and nasal passage via inhalation/intranasal administration, or are administered systemically, e.g. by via intravenous injection.

BACKGROUND

RNA interference or "RNAi" is a term initially coined by Fire and co-workers to describe the observation that double-stranded RNA (dsRNA) can block gene expression when it is introduced into worms (Fire et al., *Nature* 391:806-811, 1998). Short dsRNA directs gene-specific, post-transcriptional silencing in many organisms, including vertebrates, and has provided a new tool for studying gene function. This technology has been reviewed numerous times recently, see, for example Novina, C.D:, and Sharp, P., Nature 2004, 430: 161, and Sandy, P., et al., Biotechniques 2005, 39:215, hereby incorporated by reference.

Influenza is one of the most widely spread infections worldwide. It can be deadly: an estimated 20 to 40 million people died during the 1918 influenza A virus pandemic. In the United States between 20 and 40 thousand people die from influenza A virus infection or its complications each year. During epidemics the number of influenza related hospitalizations may reach over 300,000 in a single winter season.

Several properties contribute to the epidemiological success of influenza virus. First, it is spread easily from person to person by aerosol (droplet infection). Second, small changes in influenza virus antigens are frequent (antigenic drift) so that the virus readily escapes protective immunity induced by a previous exposure to a different variant of the virus. Third, new strains of influenza virus can be easily generated by reassortment or mixing of genetic material between different strains (antigenic shift). In the case of influenza A virus, such mixing can occur between subtypes or strains that affect different species. The 1918 pandemic is thought to have been caused by a hybrid strain of virus derived from reassortment between a swine and a human influenza A virus. At present, there is a spreading concern about the potential emergence of novel influenza strains infective to humans, particularly from avian influenza variants, and more particularly from strain H5N1, by mixing in humans concurrently exposed to human and avian influenza virus. The close contact between agricultural birds and their human breeders familiar in most asian societies has experts convinced that it is not a question of whether but only when such a mixed strain will arise. A world-wide pandemic could swiftly ensue, with even graver consequences than in 1918.

Despite intensive efforts, there is still no effective therapy for influenza virus infection and existing vaccines are limited in value in part because of the properties of antigenic shift and drift described above. For these reasons, global surveillance of influenza A virus has been underway for many years, and the National Institutes of Health designates it as one of the top priority pathogens for biodefense. Although current vaccines based upon inactivated virus are able to prevent illness in approximately 70-80% of healthy individuals under age 65, this percentage is far lower in the elderly or immunocompromised. In addition, the expense and potential side effects associated with vaccine administration make this approach less than optimal. Although the antiviral drugs currently approved in the United States for treatment and/or prophylaxis of influenza are helpful, their use is limited due to concerns about side effects, compliance, and possible emergence of resistant strains.

US patent application 20040242518 and corresponding WO 04/028471, both filed Sep. 29, 2003, propose a limited number of RNAi agents for the treatment of influenza. Their efficacy in humans is not disclosed.

Therefore, there still remains a need for the development of effective therapies for the treatment and prevention of influenza infection in humans and animals, and particularly for therapies with high efficiency that allow the targeting of a broad range of influenza subtypes. One prerequisite for high efficiency is that the active ingredient is not degraded quickly in a physiological environment.

SUMMARY

The present invention is based on the in vitro and in vivo demonstration that influenza virus infection can be inhibited through intranasal administration of iRNA agents, as well as by parenteral administration of such agents and the identification of potent iRNA agents from the MP, NP, PB1, PB2, or PA gene of influenza virus that can reduce RNA levels of several subtypes of influenza virus. Based on these findings, the present invention provides specific compositions and methods that are useful in reducing influenza virus mRNA levels, influenza virus protein levels and influenza virus viral titers in a subject, e.g., a mammal, such as a human.

The present invention specifically provides iRNA agents consisting of, consisting essentially of or comprising at least 15 or more contiguous nucleotides of one of the genes of influenza virus, particularly the MP, NP, PB1, PB2 and PA genes of influenza virus, and more particularly agents that comprising 15 or more contiguous nucleotides from one of the sequences provided in Tables 1A-1H. The iRNA agent preferably comprises less than 30 nucleotides per strand, e.g., 21-23 nucleotides, such as those provided in Tables 1A-1H. The double stranded iRNA agent can either have blunt ends or more preferably have overhangs of 1-4 nucleotides from one or both 3' ends of the agent.

Further, the iRNA agent can either contain only naturally occurring ribonucleotide subunits, or can be synthesized so as to contain one or more modifications to the sugar or base of one or more of the ribonucleotide subunits that is included in the agent. The iRNA agent can be further modified so as to be attached to a ligand that is selected to improve stability, distribution or cellular uptake of the agent, e.g. cholesterol. The iRNA agents can further be in isolated form or can be part of a pharmaceutical composition used for the methods described herein, particularly as a pharmaceutical composition formulated for delivery to the lungs or nasal passage or formulated for parental administration. The pharmaceutical compositions can contain one or more iRNA agents, and in some embodiments, will contain two or more iRNA agents, each one directed to a different segment of a influenza virus gene or a different influenza virus gene.

One aspect of the present invention relates to a double-stranded oligonucleotide comprising at least one non-natural nucleobase. In certain embodiments, the non-natural nucleobase is difluorotolyl, nitroindolyl, nitropyrrolyl, or nitroimidazolyl. In a preferred embodiment, the non-natural nucleobase is difluorotolyl. In certain embodiments, only one of the two oligonucleotide strands comprising the double-stranded oligonucleotide contains a non-natural nucleobase. In certain embodiments, both of the oligonucleotide strands comprising the double-stranded oligonucleotide independently contain a non-natural nucleobase.

The present invention further provides methods for reducing the level of influenza virus viral RNA in a cell. Such methods comprise the step of administering one of the iRNA agents of the present invention to a subject as further described below. The present methods utilize the cellular mechanisms involved in RNA interference to selectively degrade the viral RNA in a cell and are comprised of the step of contacting a cell with one of the antiviral iRNA agents of the present invention. Such methods can be performed directly on a cell or can be performed on a mammalian subject by administering to a subject one of the iRNA agents/pharmaceutical compositions of the present invention. Reduction of viral RNA in a cells results in a reduction in the amount of viral protein produced, and in an organism, results in a decrease in replicating viral titer (as shown in the Examples).

The methods and compositions of the invention, e.g., the methods and iRNA agent compositions can be used with any dosage and/or formulation described herein, as well as with any route of administration described herein. Particularly important is the showing herein of intranasal administration of an iRNA agent and its ability to inhibit viral replication in respiratory tissues.

The details of one or more embodiments of the invention are set forth in the accompanying drawings and the description below. Other features, objects, and advantages of the invention will be apparent from this description, the drawings, and from the claims. This application incorporates all cited references, patents, and patent applications by references in their entirety for all purposes.

DETAILED DESCRIPTION

Figure 1A:
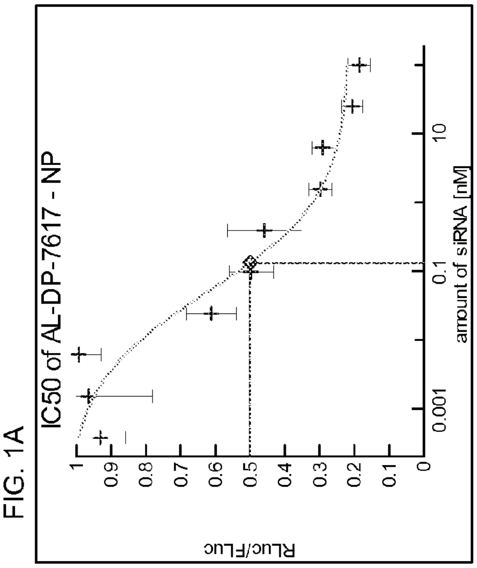
FIGS. 1A-1I: Dose-response curves for the inhibition of target gene expression for selected RNAi agents. The respective target gene was recombinantly cloned into Cos-7 cells in a plasmid resulting in expression of an mRNA encoding the target gene and Renilla luciferase, the cells treated with the RNAi agent, and Renilla luciferase was quantified. Cells were treated with the RNAi agent at concentrations of 100 nM, 25 nM, 6.3 nM, 1.6 nM, 400 pM, 100 pM, 24 pM, 6 pM, 1.5 pM, and 380 fM, and $IC_{50}$ values determined by parametrized curve fitting using the program XLfit.
Figure 1B:
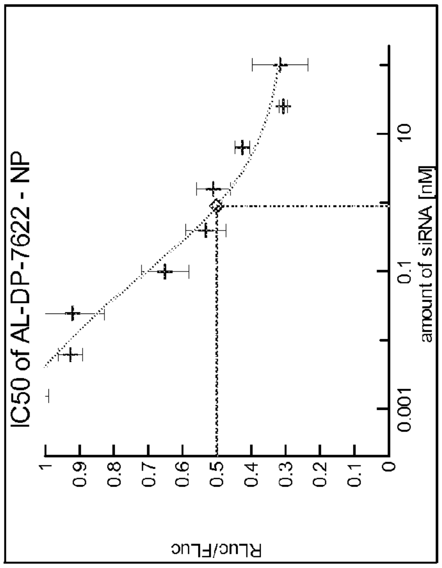
Figure 1C:
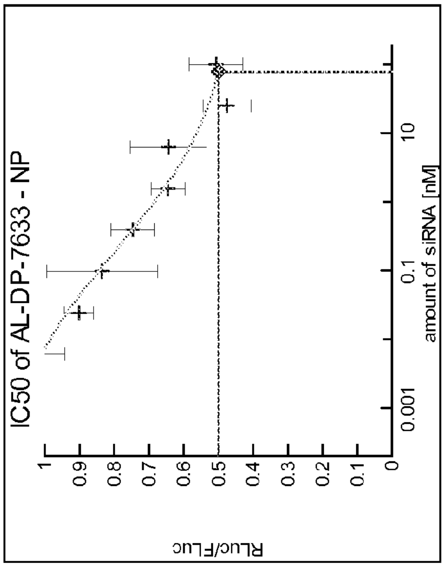
Figure 1D:
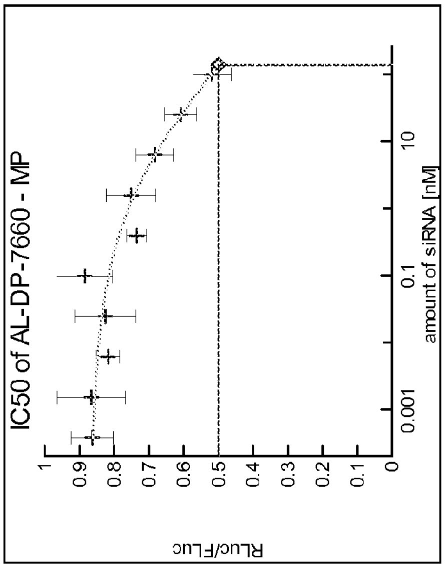
Figure 1E:
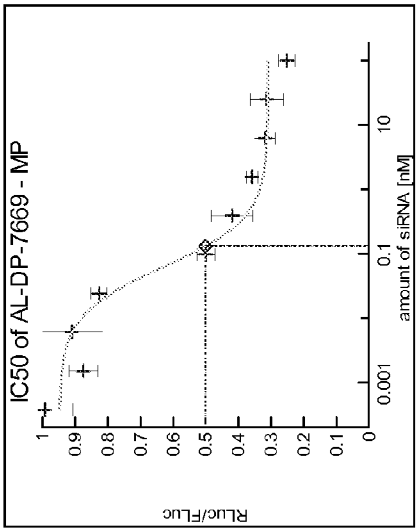
Figure 1F:
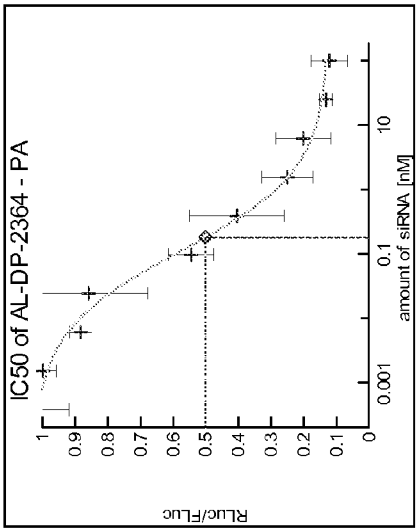
Figure 1G:
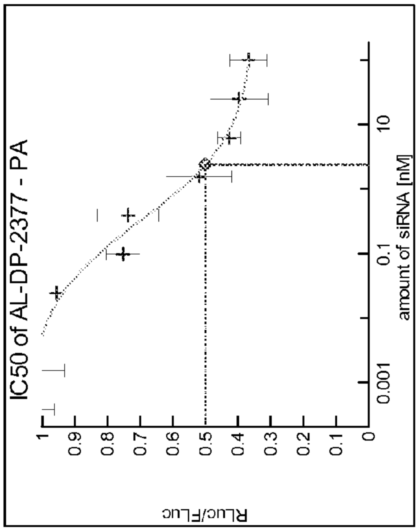
Figure 1H:
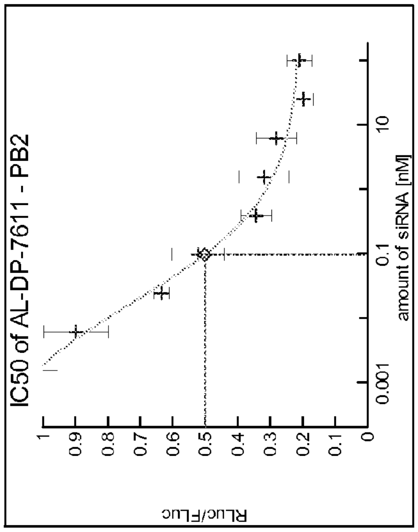
Figure 1I:
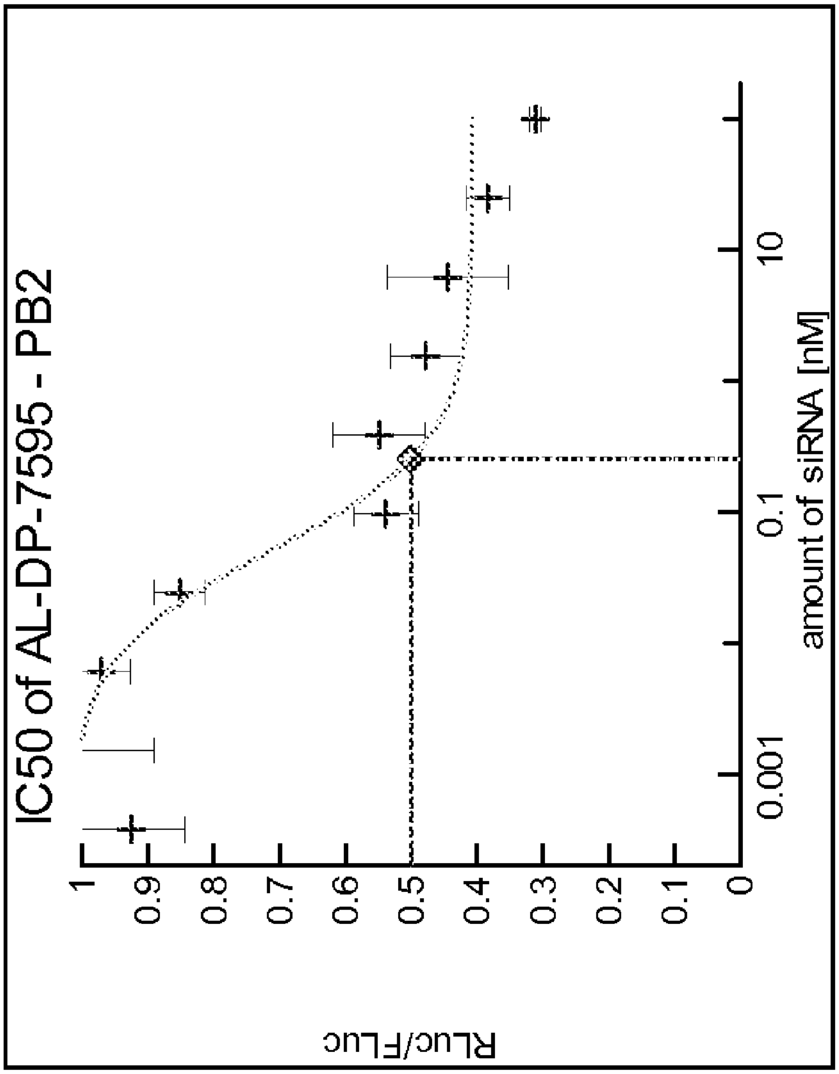

The term "influenza virus" is used here to refer to any strain of influenza virus that is capable of causing disease in an animal or human subject, or that is an interesting candidate for experimental analysis. Influenza viruses are described in Fields, B., et al., Fields' Virology, $4^{th}$ ed. 2001, Lippincott Williams and Wilkins; Philadelphia, ISBN: 0781718325. In particular, the term encompasses any strain of influenza A virus that is capable of causing disease in an animal or human subject, or that is an interesting candidate for experimental analysis. A large number of influenza A isolates have been partially or completely sequenced. Table 6 presents merely a partial list of complete sequences for influenza A genome segments that have been deposited in a public database (The influenza Sequence Database (ISD), see Macken, C., Lu, H., Goodman, J., & Boykin, L., "The value of a database in surveillance and vaccine selection." in Options for the Control of influenza IV. A. D. M. E. Osterhaus, N. Cox & A. W. Hampson (Eds.) 2001, Elsevier Science, Amsterdam, pp 103-106). This database also contains complete sequences for influenza B and C genome segments. The database is available on the World Wide Web and includes a convenient search engine that allows the user to search by genome segment, by species infected by the virus, and by year of isolation. Influenza sequences are also available on Genbank. Sequences of influenza genes are therefore readily available to, or determinable by, those of ordinary skill in the art.

For ease of exposition the term "nucleotide" or "ribonucleotide" is sometimes used herein in reference to one or more monomeric subunits of an RNA agent. It will be understood that the usage of the term "ribonucleotide" or "nucleotide" herein can, in the case of a modified RNA or nucleotide surrogate, also refer to a modified nucleotide, or surrogate replacement moiety, as further described below, at one or more positions.

An "RNA agent" as used herein, is an unmodified RNA, modified RNA, or nucleoside surrogate, each of which is described herein or is well known in the RNA synthetic art. While numerous modified RNAs and nucleoside surrogates are described, preferred examples include those which have greater resistance to nuclease degradation than do unmodified RNAs. Preferred examples include those that have a 2' sugar modification, a modification in a single strand overhang, preferably a 3' single strand overhang, or, particularly if single stranded, a 5'-modification which includes one or more phosphate groups or one or more analogs of a phosphate group.

An "iRNA agent" (abbreviation for "interfering RNA agent") as used herein, is an RNA agent, which can down-regulate the expression of a target gene, e.g., influenza virus. While not wishing to be bound by theory, an iRNA agent may act by one or more of a number of mechanisms, including post-transcriptional cleavage of a target mRNA sometimes referred to in the art as RNAi, or pre-transcriptional or pre-translational mechanisms. An iRNA agent can be a double stranded iRNA agent.

A "ds iRNA agent" (abbreviation for "double stranded iRNA agent"), as used herein, is an iRNA agent which includes more than one, and preferably two, strands in which interstrand hybridization can form a region of duplex structure. A "strand" herein refers to a contigouous sequence of nucleotides (including non-naturally occurring or modified nucleotides). The two or more strands may be, or each form a part of, separate molecules, or they may be covalently interconnected, e.g., by a linker, e.g., a polyethyleneglycol linker, to form one molecule. At least one strand can include a region which is sufficiently complementary to a target RNA. Such strand is termed the "antisense strand." A second strand of the dsRNA agent, which comprises a region complementary to the antisense strand, is termed the "sense strand." However, a ds iRNA agent can also be formed from a single RNA molecule which is at least partly self-complementary, forming, e.g., a hairpin or panhandle structure, including a duplex region. The latter are herein referred to as short hairpin RNAs or shRNAs. In such case, the term "strand" refers to one of the regions of the RNA molecule that is complementary to another region of the same RNA molecule.

Although, in mammalian cells, long ds iRNA agents can induce the interferon response which is frequently deleterious, short ds iRNA agents do not trigger the interferon response, at least not to an extent that is deleterious to the cell and/or host (Manche et al., *Mol. Cell. Biol.* 12:5238, 1992; Lee et al., *Virology* 199:491, 1994; Castelli et al., *J. Exp. Med.* 186:967, 1997; Zheng et al., *RNA* 10:1934, 2004; Heidel et al., "Lack of interferon response in animals to naked siRNAs" *Nature Biotechn. advance online publication* doi:10.1038/nbt1038, Nov. 21, 2004). The iRNA agents of the present invention include molecules which are sufficiently short that they do not trigger a deleterious non-specific interferon response in normal mammalian cells. Thus, the administration of a composition including an iRNA agent (e.g., formulated as described herein) to a subject can be used to decreased expression of the influenza virus genes in influenza virus expressing cells in the subject, while circumventing an interferon response. Molecules that are short enough that they do not trigger a deleterious interferon response are termed siRNA agents or siRNAs herein. "siRNA agent" or "siRNA" as used herein, refers to an iRNA agent, e.g., a ds iRNA agent, that is sufficiently short that it does not induce a deleterious interferon response in a mammalian, and particularly a human, cell, e.g., it has a duplexed region of less than 60 but preferably less than 50, 40, or 30 nucleotide pairs.

The isolated iRNA agents described herein, including ds iRNA agents and siRNA agents, can mediate the decreased expression of a influenza virus nucleic acid, e.g., by RNA degradation. For convenience, such RNA is also referred to herein as the RNA to be silenced. Such a nucleic acid is also referred to as a target gene. Preferably, the RNA to be silenced is a gene product of a influenza virus gene that is part of an influenzy virus strain that is pathogenic to humans.

As used herein, the phrase "mediates RNAi" refers to the ability of an agent to silence, in a sequence specific manner, a target gene. "Silencing a target gene" means the process whereby a cell containing and/or expressing a certain product of the target gene when not in contact with the agent, will contain and/or express at least 10%, 20%, 30%, 40%, 50%, 60%, 70%, 80%, or 90% less of such gene product when contacted with the agent, as compared to a similar cell which has not been contacted with the agent. Such product of the target gene can, for example, be a messenger RNA (mRNA), a protein, or a regulatory element.

As used herein, the term "complementary" is used to indicate a sufficient degree of complementarity such that stable and specific binding occurs between a compound of the invention and a target RNA molecule, e.g., a influenza virus mRNA. Specific binding requires a sufficient degree of complementarity to avoid non-specific binding of the oligomeric compound to non-target sequences under conditions in which specific binding is desired, i.e., under physiological conditions in the case of in vivo assays or therapeutic treatment, or in the case of in vitro assays, under conditions in which the assays are performed. The non-target sequences typically differ from the target sequences by at least 2, 3 or 4 nucleotides.

As used herein, an iRNA agent is "sufficiently complementary" to a target RNA, e.g., a target mRNA (e.g., a target influenza virus mRNA) if the iRNA agent reduces the production of a protein encoded by the target RNA in a cell. The iRNA agent may also be "exactly complementary" to the target RNA, e.g., the target RNA and the iRNA agent anneal, preferably to form a hybrid made exclusively of Watson-Crick basepairs in the region of exact complementarity. A "sufficiently complementary" iRNA agent can include an internal region (e.g., of at least 10 nucleotides) that is exactly complementary to a target influenza virus RNA. Moreover, in some embodiments, the iRNA agent specifically discriminates a single-nucleotide difference. In this case, the iRNA agent only mediates RNAi if exact complementarity is found in the region (e.g., within 7 nucleotides of) the single-nucleotide difference. Preferred iRNA agents will be based on or consist of or comprise the sense and antisense sequences provided in Table 1A-1H.

As used herein, "essentially identical" when used referring to a first nucleotide sequence in comparison to a second nucleotide sequence means that the first nucleotide sequence is identical to the second nucleotide sequence except for up to one, two or three nucleotide substitutions (e.g., adenosine replaced by uracil). "Essentially retaining the ability to inhibit influenza virus expression in cultured human influenza virus expressing cells," as used herein referring to an iRNA agent not identical to but derived from one of the iRNA agents of Tables 1A-1H by deletion, addition or substitution of nucleotides, means that the derived iRNA agent possesses an inhibitory activity not less than 20% of the inhibitory activity of the iRNA agent of Tables 1A-1H from which it was derived. For example, an iRNA agent derived from an iRNA agent of Tables 1A-1H which lowers the amount of influenza virus mRNA present in cultured human cells infected with influenza virus by 70% may itself lower the amount of influenza virus mRNA present in cultured human cells infected with influenza virus by at least 50% in order to be considered as essentially retaining the ability to inhibit influenza virus replication in cultured human cells infected with influenza virus. Optionally, an iRNA agent of the invention may lower the amount of influenza virus mRNA present in cultured human cells infected with influenza virus by at least 50%.

As used herein, a "subject" refers to a mammalian organism undergoing treatment for a disorder mediated by infection with an influenza virus. The subject can be any mammal, such as a cow, horse, mouse, rat, dog, pig, goat, or a primate. In the preferred embodiment, the subject is a human.

Influenza Viral Characteristics

Influenza viruses are enveloped, negative-stranded RNA viruses of the Orthomyxoviridae family. They are classified as influenza types A, B, and C, of which influenza A is the most pathogenic and is believed to be the only type able to undergo reassortment with animal strains. Influenza types A, B, and C can be distinguished by differences in their nucleoprotein and matrix proteins. As discussed further below, influenza A subtypes are defined by variation in their hemagglutinin (HA) and neuraminidase (NA) genes and usually distinguished by antibodies that bind to the corresponding proteins.

The influenza A viral genome consists of ten genes distributed in eight RNA segments. The genes encode 10 proteins: the envelope glycoproteins hemagglutinin (HA) and neuraminidase (NA); matrix protein (referred to as M1 or MP herein); nucleoprotein (NP); three polymerases (PB1, PB2, and PA) which are components of an RNA-dependent RNA transcriptase also referred to as a polymerase or polymerase complex herein; ion channel protein (M2), and nonstructural proteins (NS1 and NS2). See Julkunen, I., et al., Cytokine and Growth Factor Reviews, 12: 171-180, 2001 for further details regarding the influenza A virus and its molecular pathogenesis. See also Fields, B., et al., Fields' Virology, 4.sup.th. ed., Philadelphia: Lippincott Williams and Wilkins; ISBN: 0781718325, 2001. The organization of the influenza B viral genome is extremely similar to that of influenza A whereas the influenza C viral genome contains seven RNA segments and lacks the NA gene.

Influenza A virus classification is based on the hemagglutinin (H1-H15) and neuraminidase (N1-N9) genes. World Health Organization (WHO) nomenclature defines each virus strain by its animal host of origin (specified unless human), geographical origin, strain number, year of isolation, and antigenic description of HA and NA. For example, A/Puerto Rico/8/34 (H1N1) designates strain A, isolate 8, that arose in humans in Puerto Rico in 1934 and has antigenic subtypes 1 of HA and NA. As another example, A/Chicken/Hong Kong/258/97 (H5N1) designates strain A, isolate 258, that arose in chickens in Hong Kong in 1997 and has antigenic subtype 5 of HA and 1 of NA. Human epidemics have been caused by viruses with HA types H1, H2, and H3 and NA types N1 and N2.

As mentioned above, genetic variation occurs by two primary mechanisms in influenza virus A. Antigenic drift occurs via point mutations, which often occur at antigenically significant positions due to selective pressure from host immune responses, and antigenic shift (also referred to as reassortment), involving substitution of a whole viral genome segment of one subtype by another. Many different types of animal species including humans, swine, birds, horses, aquatic mammals, and others, may become infected with influenza A viruses. Some influenza A viruses are restricted to a particular species and will not normally infect a different species. However, some influenza A viruses may infect several different animal species, principally birds (particularly migratory water fowl), swine, and humans. This capacity is considered to be responsible for major antigenic shifts in influenza A virus. For example, suppose a swine becomes infected with an influenza A virus from a human and at the same time becomes infected with a different influenza A virus from a duck. When the two different viruses reproduce in the swine cells, the genes of the human strain and duck strain may "mix," resulting in a new virus with a unique combination of RNA segments. This process is called genetic reassortment. (Note that this type of genetic reassortment is distinct from the exchange of genetic information that occurs between chromosomes during meiosis.)

Like other viruses and certain bacterial species, influenza viruses replicate intracellularly. Influenza A viruses replicate in epithelial cells of the upper respiratory tract. However, monocytes/macrophages and other white blood cells can also be infected. Numerous other cell types with cell surface glycoproteins containing sialic acid are susceptible to infection in vitro since the virus uses these molecules as a receptor.

Design and Selection of iRNA Agents

As used herein, "disorders associated with influenza virus expression" refers to any biological or pathological state that (1) is mediated at least in part by the presence of an influenza virus and (2) whose outcome can be affected by reducing the level of the influenza virus present. Specific disorders associated with influenza virus expression are noted below.

The present invention is based on the design, synthesis and generation of iRNA agents that target viral genes of influenza virus, and the demonstration of silencing of a viral gene in vitro in cultured cells after incubation with an iRNA agent, and the resulting protective effect towards viral infection.

An iRNA agent can be rationally designed based on sequence information and desired characteristics. For example, an iRNA agent can be designed according to the relative melting temperature of the candidate duplex. Generally, the duplex should have a lower melting temperature at the 5' end of the antisense strand than at the 3' end of the antisense strand.

The present invention provides compositions containing siRNA(s) and/or shRNA(s) targeted to one or more influenza virus transcripts. As the description of the influenza virus replicative cycle presented above demonstrates, various types of viral RNA transcripts (primary and secondary vRNA, primary and secondary viral mRNA, and viral cRNA) are present within cells infected with influenza virus and play important roles in the viral life cycle. Any of these transcripts are appropriate targets for siRNA mediated inhibition by either a direct or an indirect mechanism in accordance with the present invention. siRNAs and shRNAs that target any viral mRNA transcript will specifically reduce the level of the transcript itself in a direct manner, i.e., by causing degradation of the transcript. In addition, as discussed below, siRNAs and shRNAs that target certain viral transcripts (e.g., MP, PA, PB1) will indirectly cause reduction in the levels of viral transcripts to which they are not specifically targeted. In situations where alternative splicing is possible, as for the mRNA that encodes MP and M2 and the mRNA that encodes NS1 and NS2, the unspliced transcript or the spliced transcript may serve as a target transcript.

Potential viral transcripts that may serve as a target for RNAi based therapy according to the present invention include, for example, 1) any influenza virus genomic segment; 2) transcripts that encode any viral proteins including transcripts encoding the proteins PB1, PB2, PA, NP, NS1, NS2, MP, M2, HA, or NA. As will be appreciated, transcripts may be targeted in their vRNA, cRNA, and/or mRNA form(s) by a single siRNA or shRNA. However, it may be that viral mRNA is the sole or primary target of RNAi as suggested by Ge et al., WO 04/028471.

For any particular gene target that is selected, the design of siRNAs or shRNAs for use in accordance with the present invention will preferably follow certain guidelines. In general, it is desirable to target sequences that are specific to the virus (as compared with the host), and that, preferably, are important or essential for viral function. Although certain viral genes, particularly those encoding HA and NA are characterized by a high mutation rate and are capable of tolerating mutations, certain regions and/or sequences tend to be conserved. According to certain embodiments of the invention such sequences may be particularly appropriate targets. As described further below, such conserved regions can be identified, for example, through review of the literature and/or comparisons of influenza gene sequences, a large number of which are publicly available. Also, in many cases, the agent that is delivered to a cell according to the present invention may undergo one or more processing steps before becoming an active suppressing agent (see below for further discussion); in such cases, those of ordinary skill in the art will appreciate that the relevant agent will preferably be designed to include sequences that may be necessary for its processing. One aspect of the present invention is the recognition that when multiple strains, subtypes, etc. (referred to collectively as variants), of an infectious agent exist, whose genomes vary in sequence, it will often be desirable to select and/or design siRNAs and shRNAs that target regions that are highly conserved among different variants. In particular, by comparing a sufficient number of sequences and selecting highly conserved regions, it will be possible to target multiple variants with a single siRNA whose duplex portion includes such a highly conserved region. Generally such regions should be of sufficient length to include the entire duplex portion of the siRNA (e.g., 19 nucleotides) and, optionally, one or more 3' overhangs, though regions shorter than the full length of the duplex can also be used (e.g., 15, 16, 17, or 18 nucleotides). According to certain embodiments of the invention a region is highly conserved among multiple variants if it is identical among the variants. According to certain embodiments of the invention a region (of whatever length is to be included in the duplex portion of the siRNA, e.g., 15, 16, 17, 18, or, preferably, 19 nucleotides) is highly conserved if it differs by at most one nucleotide (i.e., 0 or 1 nucleotide) among the variants. According to certain embodiments of the invention such a region is highly conserved among multiple variants if it differs by at most two nucleotides (i.e., 0, 1, or 2 nucleotides) among the variants. According to certain embodiments of the invention a region is highly conserved among multiple variants if it differs by at most three nucleotides or (i.e., 0, 1, 2, or 3 nucleotides) among the variants. According to certain embodiments of the invention an siRNA includes a duplex portion that targets a region that is highly conserved among at least 5 variants, at least variants, at least 15 variants, at least 20 variants, at least 25 variants, at least 30 variants, at least 40 variants, or at least 50 or more variants.

In order to determine whether a region is highly conserved among a set of multiple variants, the following procedure may be used. One member of the set of sequences is selected as the base sequence, i.e., the sequence to which other sequences are to be compared. Typically the length of the base sequence will be the length desired for the duplex portion of the siRNA, e.g, 15, 16, 17, 18, or, preferably 19 nucleotides. According to different embodiments of the invention the base sequence may be either one of the sequences in the set being compared or may be a consensus sequence derived, e.g., by determining for each position the most frequently found nucleotide at that position among the sequences in the set.

Having selected a base sequence, the sequence of each member of the set of multiple variants is compared with the base sequence. The number of differences between the base sequence and any member of the set of multiple variants over a region of the sequence is used to determine whether the base sequence and that member are highly conserved over the particular region of interest. As noted above, in various embodiments of the invention if the number of sequence differences between two regions is either 0; 0 or 1, 0, 1, or 2; or 0, 1, 2, or 3, the regions are considered highly conserved. At the positions where differences occur, the siRNA sequence may be selected to be identical to the base sequence or to one of the other sequences. Generally the nucleotide present in the base sequence will be selected. However in certain embodiments of the invention, particularly if a nucleotide present at a particular position in a second sequence in the set being compared is found in more of the sequences being compared than the nucleotide in the base sequence, then the siRNA sequence may be selected to be identical to the second sequence. In addition according to certain embodiments of the invention, if the consensus nucleotide (most commonly occurring nucleotide) at the position where the difference occurs is different to that found in the base sequence, the consensus nucleotide may be used. Note that this may result in a sequence that is not identical to any of the sequences being compared (as may the use of a consensus sequence as the base sequence).

The inventors have found that a significant proportion of the sequences selected using the design parameters described hereinbelow (see Example 1) prove to be efficient in suppressing viral replication when included in an siRNA or shRNA and tested as described below.

Based on the results shown herein, the present invention provides iRNA agents that reduce influenza virus replication in cultured cells infected with influenza virus and in a subject, e.g. a mammalian, for example a human. Tables 1A-1H provide exemplary iRNA agents targeting influenza virus. Table 1A, C, D, and E list siRNAs that do not comprise nucleotide modifications except for one phosphorothioate linkage between the 3'-terminal and the penultimate thymidines. Table 1B and H list siRNAs wherein all nucleotides comprising pyrimidine bases are 2'-O-methyl-modified nucleotides in the sense strand, and all uridines in a sequence context of 5'-ua-3' as well as all cytidines in a sequence context of or 5'-ca-3' are 2'-O-methyl-modified nucleotides in the antisense strand, except for the iRNA agents with duplex identified AL-DP-2295, AL-DP-2301, and AL-DP-2302, in which all uridines in a sequence context of 5'-ug-3' are 2'-O-methyl-modified nucleotides in the antisense strand. These latter siRNAs had no occurrences of the sequence motifs 5'-ua-3' or 5'-ca-3', and an analyis of degradation fragments after incubation of these agents in mouse serum revealed that the sequence motif 5'-ug-3' was the primary point of endonucleolytic attack.

Based on these results, the invention specifically provides an iRNA agent that includes a sense strand having at least 15 contiguous nucleotides of the sense strand sequences of the agents provided in Tables 1A-1H, and an antisense strand having at least 15 contiguous nucleotides of the antisense sequences of the agents provided in Tables 1A-1H.

The iRNA agents shown in Tables 1A-1H are composed of two strands of 19 nucleotides in length which are complementary or identical to the target sequence, plus a 3'-TT overhang. The present invention provides agents that comprise at least 15, or at least 16, 17, or 18, or 19 contiguous nucleotides from these sequences. However, while these lengths may potentially be optimal, the iRNA agents are not meant to be limited to these lengths. The skilled person is well aware that shorter or longer iRNA agents may be similarly effective, since, within certain length ranges, the efficacy is rather a function of the nucleotide sequence than strand length. For example, Yang, et al., *PNAS* 99:9942-9947 (2002), demonstrated similar efficacies for iRNA agents of lengths between 21 and 30 base pairs. Others have shown effective silencing of genes by iRNA agents down to a length of approx. 15 base pairs (Byrom, et al., "Inducing RNAi with siRNA Cocktails Generated by RNase III" *Tech Notes* 10(1), Ambion, Inc., Austin, Tex.).

Therefore, it is possible and contemplated by the instant invention to select from the sequences provided in Tables 1A-1H a partial sequence of between 15 to 19 nucleotides for the generation of an iRNA agent derived from one of the sequences provided in Tables 1A-1H. Alternatively, one may add one or several nucleotides to one of the sequences provided in Tables 1A-1H, or an agent comprising 15 contiguous nucleotides from one of these agents, preferably, but not necessarily, in such a fashion that the added nucleotides are complementary to the respective sequence of the target gene, e.g., an influenza virus gene. For example, the first 15 nucleotides from one of the agents can be combined with the 8 nucleotides found 5' to these sequence in the influenza virus mRNA to obtain an agent with 23 nucleotides in the sense and antisense strands. All such derived iRNA agents are included in the iRNA agents of the present invention, provided they essentially retain the ability to inhibit influenza virus replication in cultured human cells infected with influenza virus.

TABLE 1A

Exemplary iRNA agents for targeting influenza virus having 80% target coverage (criterium 1, see example 1) and 79.9% target efficiency (criterium 2, see example 1), and having an off target score of less than 16.8 (see example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression,, % inhibition[4] |
|---|---|---|---|---|---|---|---|---|---|
| AL-DP-2241 | uggaagcaauggcuuuccuTT | 1 | aggaaagccauugcuuccaTT | 2 | PB1 | | 3 | −31 | |
| AL-DP-2242 | ggcaccaaacgaucuuaugTT | 3 | cauaagaucguuuggugccTT | 4 | NP | | −10 | 28 | 63 |
| AL-DP-2243 | aggcaccaaacgaucuuauTT | 5 | auaagaucguuuggugccuTT | 6 | NP | | −34 | 15 | 51 |
| AL-DP-2244 | gcaccaaacgaucuuaugaTT | 7 | ucauaagaucguuuggugcTT | 8 | NP | <50 | −26 | 74 | 76 |
| AL-DP-2245 | cuucuaaccgaggucgaaaTT | 9 | uuucgaccucgguuagaagTT | 10 | MP | | −20 | −72 | |
| AL-DP-2246 | gucgaaacguacguucucuTT | 11 | agagaacguacguuucgacTT | 12 | MP | | −2 | −70 | |
| AL-DP-2247 | cucaaagccgagaucgcgcTT | 13 | gcgcgaucucggcuuugagTT | 14 | MP | | −4 | −95 | |
| AL-DP-2248 | uucuaaccgaggucgaaacTT | 15 | guuucgaccucgguuagaaTT | 16 | MP | | −23 | −37 | |
| AL-DP-2249 | ucuaaccgaggucgaaacgTT | 17 | cguuucgaccucgguuagaTT | 18 | MP | | −1 | 18 | |
| AL-DP-2250 | ucgaaacguacguucucucTT | 19 | gagagaacguacguuucgaTT | 20 | MP | | −27 | 15 | |
| AL-DP-2251 | cgaaacguacguucucucuTT | 21 | agagagaacguacguuucgTT | 22 | MP | | −16 | 12 | |
| AL-DP-2252 | aaacguacguucucucuauTT | 23 | auagagagaacguacguuuTT | 24 | MP | | −21 | −24 | |
| AL-DP-2253 | cccccucaaagccgagaucTT | 25 | gaucucggcuuugagggggTT | 26 | MP | | −14 | 6 | |
| AL-DP-2254 | cccucaaagccgagaucgcTT | 27 | gcgaucucggcuuugagggTT | 28 | MP | | −22 | −24 | |
| AL-DP-2255 | ccucaaagccgagaucgcgTT | 29 | cgcgaucucggcuuugaggTT | 30 | MP | | −11 | −14 | |
| AL-DP-2256 | acaagaccaauccugucacTT | 31 | gugacaggauuggucuuguTT | 32 | MP | | 17 | −22 | |
| AL-DP-2257 | agcgaggacugcagcguagTT | 33 | cuacgcugcaguccucgcuTT | 34 | MP | | 1 | −124 | |
| AL-DP-2258 | cgaggacugcagcguagacTT | 35 | gucuacgcugcaguccucgTT | 36 | MP | | 26 | −37 | |
| AL-DP-2259 | uugcacuugauauuguggaTT | 37 | uccacaauaucaagugcaaTT | 38 | MP | | 12 | −18 | |
| AL-DP-2260 | ugcacuugauauuguggauTT | 39 | auccacaauaucaagugcaTT | 40 | MP | | −5 | −76 | |

TABLE 1A-continued

Exemplary iRNA agents for targeting influenza virus having 80% target coverage (criterium 1, see example 1) and 79.9% target efficiency (criterium 2, see example 1), and having an off target score of less than 16.8 (see example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression,, % inhibition[4] |
|---|---|---|---|---|---|---|---|---|---|
| AL-DP-2261 | auacgguuugaaaagagggTT | 41 | cccucuuuucaaaccguauTT | 42 | MP | | -1 | 5 | |
| AL-DP-2262 | uacgguuugaaaagagggcTT | 43 | gcccucuuuucaaaccguaTT | 44 | MP | | -6 | -6 | |
| AL-DP-2263 | acgguuugaaaagagggccTT | 45 | ggcccucuuuucaaaccguTT | 46 | MP | | 3 | -22 | |
| AL-DP-2264 | cgguuugaaaagagggccuTT | 47 | aggcccucuuuucaaaccgTT | 48 | MP | | 4 | 1 | |
| AL-DP-2265 | cuaaccgaggucgaaacguTT | 49 | acguuucgaccucgguuagTT | 50 | MP | | 13 | -52 | |
| AL-DP-2266 | uaaccgaggucgaaacguaTT | 51 | uacguuucgaccucgguuaTT | 52 | MP | | 27 | -107 | |
| AL-DP-2267 | aaccgaggucgaaacguacTT | 53 | guacguuucgaccucgguuTT | 54 | MP | <25% | 42 | -73 | |
| AL-DP-2268 | accgaggucgaaacguacgTT | 55 | cguacguuucgaccucgguTT | 56 | MP | | -16 | -18 | |
| AL-DP-2269 | ccgaggucgaaacguacguTT | 57 | acguacguuucgaccucggTT | 58 | MP | | -21 | -43 | |
| AL-DP-2270 | cgaggucgaaacguacguuTT | 59 | aacguacguuucgaccucgTT | 60 | MP | | -6 | -25 | |
| AL-DP-2271 | gaggucgaaacguacguucTT | 61 | gaacguacguuucgaccucTT | 62 | MP | | -29 | -29 | |
| AL-DP-2272 | aggucgaaacguacguucuTT | 63 | agaacguacguuucgaccuTT | 64 | MP | | -23 | -59 | |
| AL-DP-2273 | ggucgaaacguacguucucTT | 65 | gagaacguacguuucgaccTT | 66 | MP | | -9 | -36 | |
| AL-DP-2274 | gcuaaagacaagaccaaucTT | 67 | gauuggucuugucuuuagcTT | 68 | MP | | -24 | -17 | |
| AL-DP-2275 | aauccugucaccucugacuTT | 69 | agucagaggugacaggauuTT | 70 | MP | | -33 | -36 | |
| AL-DP-2276 | uccugucaccucugacuaaTT | 71 | uuagucagaggugacaggaTT | 72 | MP | 30% | -20 | -10 | |
| AL-DP-2277 | cacgcucaccgugcccaguTT | 73 | acugggcacggugagcgugTT | 74 | MP | | -38 | -32 | |
| AL-DP-2278 | acgcucaccgugcccagugTT | 75 | cacugggcacggugagcguTT | 76 | MP | | -26 | -17 | |
| AL-DP-2279 | cgcucaccgugcccagugaTT | 77 | ucacugggcacggugagcgTT | 78 | MP | | -36 | -7 | |
| AL-DP-2280 | gcucaccgugcccagugagTT | 79 | cucacugggcacggugagcTT | 80 | MP | | -37 | -34 | |
| AL-DP-2281 | caccgugcccagugagcgaTT | 81 | ucgcucacugggcacggugTT | 82 | MP | | -46 | -52 | |

TABLE 1A-continued

Exemplary iRNA agents for targeting influenza virus having 80% target coverage (criterium 1, see example 1) and 79.9% target efficiency (criterium 2, see example 1), and having an off target score of less than 16.8 (see example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression,, % inhibition[4] |
|---|---|---|---|---|---|---|---|---|---|
| AL-DP-2282 | gagcgaggacugcagcguaTT | 83 | uacgcugcaguccucgcucTT | 84 | MP | | -31 | -62 | |
| AL-DP-2283 | uauuguggauucuugaucgTT | 85 | cgaucaagaauccacaauaTT | 86 | MP | 45% | -52 | -26 | |
| AL-DP-2284 | uuguggauucuugaucgucTT | 87 | gacgaucaagaauccacaaTT | 88 | MP | 61% | 39 | -60 | |
| AL-DP-2285 | uguggauucuugaucgucuTT | 89 | agacgaucaagaauccacaTT | 90 | MP | 41% | 3 | -49 | |
| AL-DP-2286 | guggauucuugaucgucuuTT | 91 | aagacgaucaagaauccacTT | 92 | MP | 36% | 9 | -50 | |
| AL-DP-2287 | ucaaaugcauuuaucgucgTT | 93 | cgacgauaaaugcauuugaTT | 94 | MP | 38% | -17 | -11 | |
| AL-DP-2288 | caaaugcauuuaucgucgcTT | 95 | gcgacgauaaaugcauuugTT | 96 | MP | 39% | 23 | -58 | |

[1]in in vitro plaque forming assay in MCDK cells as described in Example 3.1;
[2]in in vitro ELISA assay in MCDK cells as described in Example 3.2:
[3]in in vitro ELISA assay in MCDK cells as described in Example 3.2;
[4]in in vitro ELISA assay in MCDK cells as described in Example 3.2;
negative values indicate that target gene expression was enhanced in treated cells compared to controls

TABLE 1B

Exemplary iRNA agents for targeting influenza virus derived from agents listed in Table 1A by stabilization towards nucleolytic degradation by nucleotide modifications

| Duplex identifier | Corresponding unmodified duplex[1] | Sense strand sequence (5'-3') | SEQ ID NO: | Antisense strand sequence (5'-3') | SEQ ID NO: | Target influenza gene |
|---|---|---|---|---|---|---|
| AL-DP-2289 | AL-DP-2241 | umggaagcmaaumggcmumumumcmcmumTT | 97 | aggaaagccmauugcuuccmaTT | 98 | PB1 |
| AL-DP-2290 | AL-DP-2242 | ggcmacmcmaaacmgaumcmumumaumgTT | 99 | cmaumaagaucguuuggugccTT | 100 | NP |
| AL-DP-2291 | AL-DP-2243 | aggcmacmcmaaacmgaumcmumumaumTT | 101 | aumaagaucguuuggugccuTT | 102 | NP |
| AL-DP-2292 | AL-DP-2244 | gcmacmcmaaacmgaumcmumumaumgaTT | 103 | ucmaumaagaucguuuggugcTT | 104 | NP |
| AL-DP-2293 | AL-DP-2245 | cmumumcmumaacmcmgaggumcmgaaaTT | 105 | uuucgaccucgguumagaagTT | 106 | MP |
| AL-DP-2294 | AL-DP-2246 | gumcmgaaacmgumacmgumumcmumcmumTT | 107 | agagaacgumacguuucgacTT | 108 | MP |
| AL-DP-2295 | AL-DP-2247 | cmumcmaaagcmcmgagaumcmgcmgcmTT | 109 | gcgcgaucucggcuuumgagTT | 110 | MP |
| AL-DP-2296 | AL-DP-2248 | umumcmumaacmcmgaggumcmgaaacmTT | 111 | guuucgaccucgguumagaaTT | 112 | MP |
| AL-DP-2297 | AL-DP-2249 | umcmumaacmcmgaggumcmgaaacmgTT | 113 | cguuucgaccucgguumagaTT | 114 | MP |
| AL-DP-2298 | AL-DP-2250 | umcmgaaacmgumacmgumumcmumcmumcmTT | 115 | gagagaacgumacguuucgaTT | 116 | MP |
| AL-DP-2299 | AL-DP-2251 | cmgaaacmgumacmgumumcmumcmumcmumTT | 117 | agagagaacgumacguuucgTT | 118 | MP |
| AL-DP-2300 | AL-DP-2252 | aaacmgumacmgumumcmumcmumcmumaumTT | 119 | aumagagagaacgumacguuuTT | 120 | MP |
| AL-DP-2301 | AL-DP-2254 | cmcmcmumcmaaagcmcmgagaumcmgcmTT | 121 | gcgaucucggcuuumgagggTT | 122 | MP |
| AL-DP-2302 | AL-DP-2255 | cmcmumcmaaagcmcmgagaumcmgcmgTT | 123 | cgcgaucucggcuuumgaggTT | 124 | MP |
| AL-DP-2303 | AL-DP-2256 | acmaagacmcmaaumcmcmumgumcmacmTT | 125 | gugacmaggauuggucuuguTT | 126 | MP |
| AL-DP-2304 | AL-DP-2257 | agcmgaggacmumgcmagcmgumagTT | 127 | cumacgcugcmaguccucgcuTT | 128 | MP |
| AL-DP-2305 | AL-DP-2258 | cmgaggacmumgcmagcmgumagacmTT | 129 | gucumacgcugcmaguccucgTT | 130 | MP |
| AL-DP-2306 | AL-DP-2259 | umumgcmacmumumgaumaumumgumggaTT | 131 | uccmacmaaumaucmaagugcmaaTT | 132 | MP |
| AL-DP-2307 | AL-DP-2260 | umgcmacmumumgaumaumumgumggaumTT | 133 | auccmacmaaumaucmaagugcmaTT | 134 | MP |
| AL-DP-2308 | AL-DP-2265 | cmumaacmcmgaggumcmgaaacmgumTT | 135 | acguuucgaccucgguumagTT | 136 | MP |
| AL-DP-2309 | AL-DP-2266 | umaacmcmgaggumcmgaaacmgumaTT | 137 | umacguuucgaccucgguumaTT | 138 | MP |
| AL-DP-2310 | AL-DP-2267 | aacmcmgaggumcmgaaacmgumacmTT | 139 | gumacguuucgaccucgguuTT | 140 | MP |
| AL-DP-2311 | AL-DP-2268 | acmcmgaggumcmgaaacmgumacmgTT | 141 | cgumacguuucgaccucgguTT | 142 | MP |
| AL-DP-2312 | AL-DP-2269 | cmcmgaggumcmgaaacmgumacmgumTT | 143 | acgumacguuucgaccucggTT | 144 | MP |

[1]duplex identifier of siRNA agent of Table 1A having an identical nucleotide sequence when nucleotide modifications are disregarded

TABLE 1C

Additional exemplary iRNA agents for targeting influenza virus not listed in Table 1A having at least 50% target coverage (criterium 1, see Example 1) and at least 80% target efficiency (criterium 2, see Example 1), and having an off target score of less than 16.8 (see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-2313 | augagucuucuaaccgaggTT | 145 | ccucgguuagaagacucauTT | 146 | MP | | -29 | 10 | |
| AL-DP-2314 | ucuucuaaccgaggucgaaTT | 147 | uucgaccucgguuagaagaTT | 148 | MP | | -51 | -53 | |
| AL-DP-2315 | gucuucuaaccgaggucgaTT | 149 | ucgaccucgguuagaagacTT | 150 | MP | | -39 | -74 | |
| AL-DP-2316 | cuucagaucgaacggucuaTT | 151 | uagaccguucgaucugaagTT | 152 | PB1 | | -63 | -34 | |
| AL-DP-2317 | cagaucgaacggucuaacaTT | 153 | uguuagaccguucgaucugTT | 154 | PB1 | | -50 | -33 | |
| AL-DP-2318 | agaucgaacggucuaacagTT | 155 | cuguuagaccguucgaucuTT | 156 | PB1 | | -43 | -13 | |
| AL-DP-2319 | caaaaugcuauaaguaccaTT | 157 | ugguacuuauagcauuuugTT | 158 | PB1 | | -42 | -65 | |
| AL-DP-2320 | uucagaucgaacggucuaaTT | 159 | uuagaccguucgaucugaaTT | 160 | PB1 | | -50 | -51 | |
| AL-DP-2321 | uaccacauucccuuauacuTT | 161 | aguauaagggaaugugguaTT | 162 | PB1 | | -35 | 1 | |
| AL-DP-2322 | ucuuacauaaaucggacagTT | 163 | cuguccgauuuauguaagaTT | 164 | PB1 | | 12 | 0 | |
| AL-DP-2323 | gucuuacauaaaucggacaTT | 165 | uguccgauuuauguaagacTT | 166 | PB1 | | 21 | -31 | |
| AL-DP-2324 | agucuuacauaaaucggacTT | 167 | guccgauuuauguaagacuTT | 168 | PB1 | | 20 | -6 | |
| AL-DP-2325 | ccucugaugauuucgcucuTT | 169 | agagcgaaaucaucagaggTT | 170 | PB1 | | 35 | -36 | |
| AL-DP-2326 | ggaugucaauccgacuuuaTT | 171 | uaaagucggauugacauccTT | 172 | PB1 | | 40 | 12 | |
| AL-DP-2327 | uuugagagagaaggguacuTT | 173 | aguacccuucucucucaaaTT | 174 | NP | | 38 | -14 | 33 |
| AL-DP-2328 | aggcaacgaacccgaucguTT | 175 | acgaucggguucguugccuTT | 176 | NP | | 36 | -44 | 65 |
| AL-DP-2329 | ggcaacgaacccgaucgugTT | 177 | cacgaucggguucguugccTT | 178 | NP | | 31 | -55 | 58 |
| AL-DP-2330 | caacgaacccgaucgugccTT | 179 | ggcacgaucggguucguugTT | 180 | NP | | 33 | -43 | 56 |

TABLE 1C-continued

Additional exemplary iRNA agents for targeting influenza virus not listed in Table 1A having at least 50% target coverage (criterium 1, see Example 1) and at least 80% target efficiency (criterium 2, see Example 1), and having an off target score of less than 16.8 (see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-2331 | gcaacgaacccgaucgugcTT | 181 | gcacgaucggguucguugcTT | 182 | NP | <75 | 24 | 44 | 67 |
| AL-DP-2332 | gaaaaggcaacgaacccgaTT | 183 | ucggguucguugccuuuucTT | 184 | NP | | 32 | 10 | 78 |
| AL-DP-2333 | ucgagcucucggacgaaaaTT | 185 | uuuucguccgagagcucgaTT | 186 | NP | <50 | 18 | 53 | 69 |
| AL-DP-2334 | aacgaacccgaucgugccuTT | 187 | aggcacgaucggguucguuTT | 188 | NP | | 35 | -19 | 30 |
| AL-DP-2335 | uauuucuucggagacaaugTT | 189 | cauugucuccgaagaaauaTT | 190 | NP | | 2 | -20 | 41 |
| AL-DP-2348 | ugcaugauaaaggcaguccTT | 191 | ggacugccuuuaucaugcaTT | 192 | PB2 | | -45 | -65 | 4 |
| AL-DP-2349 | auggggaugaucggaauauTT | 193 | auauuccgaucauccccauTT | 194 | PB2 | | 0 | 32 | 55 |
| AL-DP-2350 | uggggaugaucggaauauuTT | 195 | aauauuccgaucaucccccaTT | 196 | PB2 | | -41 | 5 | 52 |
| AL-DP-2351 | gaaacgggacucuagcauaTT | 197 | uaugcuagagucccguuucTT | 198 | PB2 | <25 | -33 | 68 | 76 |
| AL-DP-2356 | agacuuugugcgacaaugcTT | 199 | gcauugucgcacaaagucuTT | 200 | PA | | 19 | -22 | 77 |
| AL-DP-2357 | gacuuugugcgacaaugcuTT | 201 | agcauugucgcacaaagucTT | 202 | PA | | -84 | 13 | 86 |
| AL-DP-2358 | ucuaugggauuccuuucguTT | 203 | acgaaaggaaucccauagaTT | 204 | PA | | -33 | -81 | 30 |
| AL-DP-2359 | cuaugggauuccuuucgucTT | 205 | gacgaaaggaaucccauagTT | 206 | PA | | -59 | -109 | 80 |
| AL-DP-2360 | auguggauggauucgaaccTT | 207 | gguucgaauccauccacauTT | 208 | PA | | 1 | 4 | 16 |
| AL-DP-2361 | uguggauggauucgaaccgTT | 209 | cgguucgaauccauccacaTT | 210 | PA | | -10 | 28 | -7 |
| AL-DP-2362 | guggauggauucgaaccgaTT | 211 | ucgguucgaauccauccacTT | 212 | PA | <25 | -28 | 59 | 88 |
| AL-DP-2363 | uggauggauucgaaccgaaTT | 213 | uucgguucgaauccauccaTT | 214 | PA | <25 | -7 | 50 | 89 |
| AL-DP-2364 | ggauggauucgaaccgaacTT | 215 | guucgguucgaauccauccTT | 216 | PA | <25 | 55 | 65 | 89 |
| AL-DP-2365 | gauggauucgaaccgaacgTT | 217 | cguucgguucgaauccaucTT | 218 | PA | | -3 | 27 | 60 |

TABLE 1C-continued

Additional exemplary iRNA agents for targeting influenza virus not listed in Table 1A having at least 50% target coverage (criterium 1, see Example 1) and at least 80% target efficiency (criterium 2, see Example 1), and having an off target score of less than 16.8 (see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-2366 | auggauucgaaccgaacggTT | 219 | ccguucgguucgaauccauTT | 220 | PA | | 32 | 19 | 31 |
| AL-DP-2367 | uggauucgaaccgaacggcTT | 221 | gccguucgguucgaauccaTT | 222 | PA | | 0 | -52 | 14 |
| AL-DP-2368 | aucuccacaacucgaggggTT | 223 | ccccucgaguuguggagauTT | 224 | PA | | 22 | 0 | 20 |

[1]in in vitro plaque forming assay in MCDK cells as described in Example 3.1;
[2]in in vitro ELISA assay in MCDK cells as described in Example 3.2:
[3]in in vitro ELISA assay in MCDK cells as described in Example 3.2;
[4]in in vitro ELISA assay in MCDK cells as described in Example 3.2;
negative values indicate that target gene expression was enhanced in treated cells compared to controls

TABLE 1D

Additional exemplary iRNA agents for targeting influenza virus not listed in Table 1A or C, and having at least 80% target coverage (criterium 1, see Example 1) and at least 80% target efficiency (criterium 2, see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-7614 | uaacaauagagagaaugguTT | 225 | accauucucucuauuguuaTT | 226 | NP | | 17 | -80 | 35 |
| AL-DP-7635 | gaaacguacguucucucuaTT | 227 | uagagagaacguacguuucTT | 228 | MP | | 7 | 19 | |
| AL-DP-7636 | aacguacguucucucuaucTT | 229 | gauagagagaacguacguuTT | 230 | MP | | 1 | 24 | |
| AL-DP-7637 | uggcuaaagacaagaccaaTT | 231 | uuggucuugucuuuagccaTT | 232 | MP | <25 | 42 | 8 | |
| AL-DP-7638 | ggcuaaagacaagaccaauTT | 233 | auuggucuugucuuuagccTT | 234 | MP | | 19 | 5 | |
| AL-DP-7639 | cuaaagacaagaccaauccTT | 235 | ggauuggucuugucuuuagTT | 236 | MP | | 22 | 24 | |
| AL-DP-7640 | uaaagacaagaccaauccuTT | 237 | aggauuggucuugucuuuaTT | 238 | MP | | 11 | 43 | |
| AL-DP-7641 | aaagacaagaccaauccugTT | 239 | caggauuggucuugucuuuTT | 240 | MP | | 13 | 33 | |
| AL-DP-7642 | aagacaagaccaauccuguTT | 241 | acaggauuggucuugucuuTT | 242 | MP | | -12 | 39 | |
| AL-DP-7643 | agacaagaccaauccugucTT | 243 | gacaggauuggucuugucuTT | 244 | MP | | 4 | 5 | |
| AL-DP-7644 | gacaagaccaauccugucaTT | 245 | ugacaggauuggucuugucTT | 246 | MP | | 3 | 26 | |
| AL-DP-7645 | caagaccaauccugucaccTT | 247 | ggugacaggauuggucuugTT | 248 | MP | | 2 | 2 | |
| AL-DP-7646 | aagaccaauccugucaccuTT | 249 | aggugacaggauuggucuuTT | 250 | MP | | 12 | 9 | |
| AL-DP-7647 | agaccaauccugucaccucTT | 251 | gaggugacaggauuggucuTT | 252 | MP | | 8 | -5 | |
| AL-DP-7648 | gaccaauccugucaccucuTT | 253 | agaggugacaggauuggucTT | 254 | MP | | -27 | 2 | |
| AL-DP-7649 | accaauccugucaccucugTT | 255 | cagaggugacaggauugguTT | 256 | MP | | 8 | 0 | |
| AL-DP-7650 | ccaauccugucaccucugaTT | 257 | ucagaggugacaggauuggTT | 258 | MP | | -1 | 11 | |
| AL-DP-7651 | caauccugucaccucugacTT | 259 | gucagaggugacaggauugTT | 260 | MP | <50 | 30 | 16 | |
| AL-DP-7652 | auccugucaccucugacuaTT | 261 | uagucagaggugacaggauTT | 262 | MP | <50 | 69 | 9 | |
| AL-DP-7653 | uucacgcucaccgugcccaTT | 263 | ugggcacggugagcgugaaTT | 264 | MP | <75 | 31 | 6 | |

TABLE 1D-continued

Additional exemplary iRNA agents for targeting influenza virus not listed in Table 1A or C, and having at least 80% target coverage (criterium 1, see Example 1) and at least 80% target efficiency (criterium 2, see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-7654 | ucacgcucaccgugcccagTT | 265 | cugggcacggugagcgugaTT | 266 | MP | <75 | 57 | 12 | |
| AL-DP-7655 | cucaccgugcccagugagcTT | 267 | gcucacugggcacggugagTT | 268 | MP | | | 22 | |
| AL-DP-7656 | ucaccgugcccagugagcgTT | 269 | cgcucacugggcacggugaTT | 270 | MP | <75 | 69 | 10 | |
| AL-DP-7657 | accgugcccagugagcgagTT | 271 | cucgcucacugggcacgguTT | 272 | MP | | 1 | 22 | |
| AL-DP-7658 | ccgugcccagugagcgaggTT | 273 | ccucgcucacugggcacggTT | 274 | MP | <75 | 34 | 20 | |
| AL-DP-7659 | cgugcccagugagcgaggaTT | 275 | uccucgcucacugggcacgTT | 276 | MP | | 4 | 35 | |
| AL-DP-7660 | gugcccagugagcgaggacTT | 277 | guccucgcucacugggcacTT | 278 | MP | <75 | 33 | 49 | |
| AL-DP-7661 | ugcccagugagcgaggacuTT | 279 | aguccucgcucacugggcaTT | 280 | MP | <50 | -10 | 58 | |
| AL-DP-7662 | gcccagugagcgaggacugTT | 281 | caguccucgcucacugggcTT | 282 | MP | | -16 | -44 | |
| AL-DP-7663 | cccagugagcgaggacugcTT | 283 | gcaguccucgcucacugggTT | 284 | MP | | 11 | -8 | |
| AL-DP-7664 | ccagugagcgaggacugcaTT | 285 | ugcaguccucgcucacuggTT | 286 | MP | | 24 | -20 | |
| AL-DP-7665 | cagugagcgaggacugcagTT | 287 | cugcaguccucgcucacugTT | 288 | MP | | 7 | -24 | |
| AL-DP-7666 | agugagcgaggacugcagcTT | 289 | gcugcaguccucgcucacuTT | 290 | MP | <50 | 42 | -22 | |
| AL-DP-7667 | gugagcgaggacugcagcgTT | 291 | cgcugcaguccucgcucacTT | 292 | MP | | 20 | -17 | |
| AL-DP-7668 | ugagcgaggacugcagcguTT | 293 | acgcugcaguccucgcucaTT | 294 | MP | <50 | 51 | -54 | |
| AL-DP-7669 | gcgaggacugcagcguagaTT | 295 | ucuacgcugcaguccucgcTT | 296 | MP | <25 | 32 | 37 | |
| AL-DP-7670 | gaggacugcagcguagacgTT | 297 | cgucuacgcugcaguccucTT | 298 | MP | <75 | 35 | 20 | |
| AL-DP-7671 | gcacuugauauuguggauuTT | 299 | aauccacaauaucaagugcTT | 300 | MP | | -19 | 4 | |
| AL-DP-7672 | cacuugauauuguggauucTT | 301 | gaauccacaauaucaagugTT | 302 | MP | | 12 | -10 | |
| AL-DP-7673 | acuugauauuguggauucuTT | 303 | agaauccacaauaucaaguTT | 304 | MP | | 0 | -1 | |
| AL-DP-7674 | cuugauauuguggauucuuTT | 305 | aagaauccacaauaucaagTT | 306 | MP | | -8 | -36 | |

TABLE 1D-continued

Additional exemplary iRNA agents for targeting influenza virus not listed in Table 1A or C, and having at least 80% target coverage (criterium 1, see Example 1) and at least 80% target efficiency (criterium 2, see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-7675 | uugauauuguggauucuugTT | 307 | caagaauccacaauaucaaTT | 308 | MP | <75 | 2 | -27 | |
| AL-DP-7676 | ugauauuguggauucuugaTT | 309 | ucaagaauccacaauaucaTT | 310 | MP | | -29 | -40 | |
| AL-DP-7677 | gauauuguggauucuugauTT | 311 | aucaagaauccacaauaucTT | 312 | MP | | -14 | -24 | |
| AL-DP-7678 | auauuguggauucuugaucTT | 313 | gaucaagaauccacaauauTT | 314 | MP | | 24 | -22 | |
| AL-DP-7679 | ggauucuugaucgucuuuuTT | 315 | aaaagacgaucaagaauccTT | 316 | MP | | 3 | -34 | |
| AL-DP-7684 | ccgucaggcccccucaaagTT | 317 | cuuugagggggccugacggTT | 318 | MP | | -1 | 23 | |
| AL-DP-7685 | cgucaggcccccucaaagcTT | 319 | gcuuugagggggccugacgTT | 320 | MP | | -12 | 36 | |
| AL-DP-7686 | gucaggcccccucaaagccTT | 321 | ggcuuugagggggccugacTT | 322 | MP | | -4 | 14 | |
| AL-DP-7687 | ucaggcccccucaaagccgTT | 323 | cggcuuugagggggccugaTT | 324 | MP | <75 | 32 | -11 | |
| AL-DP-7688 | caggcccccucaaagccgaTT | 325 | ucggcuuugagggggccugTT | 326 | MP | <25 | 56 | -14 | |
| AL-DP-7689 | aggcccccucaaagccgagTT | 327 | cucggcuuugagggggccuTT | 328 | MP | <50 | 83 | -21 | |
| AL-DP-7690 | ggcccccucaaagccgagaTT | 329 | ucucggcuuugagggggccTT | 330 | MP | <50 | 89 | -29 | |
| AL-DP-7691 | gcccccucaaagccgagauTT | 331 | aucucggcuuugagggggcTT | 332 | MP | | 8 | -21 | |
| AL-DP-7692 | ccccucaaagccgagaucgTT | 333 | cgaucucggcuuugaggggTT | 334 | MP | | 5 | -86 | |

[1] in in vitro plaque forming assay in MCDK cells as described in Example 3.1;
[2] in in vitro ELISA assay in MCDK cells as described in Example 3.2:
[3] in in vitro ELISA assay in MCDK cells as described in Example 3.2;
[4] in in vitro ELISA assay in MCDK cells as described in Example 3.2;
negative values indicate that target gene expression was enhanced in treated cells compared to controls

TABLE 1E

Additional exemplary iRNA agents for targeting influenza virus not listed in Table 1A, C, or D, and having at least 50% target coverage (criterium 1, see Example 1) and at least 80% target efficiency (criterium 2, see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-7565 | cgagagaggcgaagagacaTT | 335 | ugucucuucgccucucucgTT | 336 | PA | <50 | -29 | 71 | 59 |
| AL-DP-7566 | gaagagacaauugaagaaaTT | 337 | uuucuucaauugucucuucTT | 338 | PA | <75 | -15 | 61 | 57 |
| AL-DP-7567 | uuuagagccuauguggaugTT | 339 | cauccacauaggcucuaaaTT | 340 | PA | <75 | -64 | 49 | 13 |
| AL-DP-7568 | uuagagccuauguggauggTT | 341 | ccauccacauaggcucuaaTT | 342 | PA | <75 | -24 | 60 | 19 |
| AL-DP-7569 | uagagccuauguggauggaTT | 343 | uccauccacauaggcucuaTT | 344 | PA | <75 | -47 | 67 | 26 |
| AL-DP-7570 | agagccuauguggauggauTT | 345 | auccauccacauaggcucuTT | 346 | PA | <50 | -23 | 87 | 72 |
| AL-DP-7571 | gagccuauguggauggauuTT | 347 | aauccauccacauaggcucTT | 348 | PA | <25 | 2 | 94 | 84 |
| AL-DP-7572 | agccuauguggauggauucTT | 349 | gaauccauccacauaggcuTT | 350 | PA | <25 | -14 | 82 | 76 |
| AL-DP-7573 | uaugaagcaauugaggaguTT | 351 | acuccucaauugcuucauaTT | 352 | PA | <75 | -58 | 48 | 6 |
| AL-DP-7574 | augaagcaauugaggagugTT | 353 | cacuccucaauugcuucauTT | 354 | PA | | -69 | 16 | 4 |
| AL-DP-7575 | ugaagcaauugaggagugcTT | 355 | gcacuccucaauugcuucaTT | 356 | PA | | -65 | 99 | 2 |
| AL-DP-7576 | gaagcaauugaggagugccTT | 357 | ggcacuccucaauugcuucTT | 358 | PA | <25 | -23 | 99 | 63 |
| AL-DP-7577 | aagcaauugaggagugccuTT | 359 | aggcacuccucaauugcuuTT | 360 | PA | <25 | -27 | 99 | 60 |
| AL-DP-7578 | gaucccuggguuuugcuuaTT | 361 | uaagcaaaacccagggaucTT | 362 | PA | <50 | -50 | 96 | 80 |
| AL-DP-7579 | aucccuggguuuugcuuaaTT | 363 | uuaagcaaaacccagggauTT | 364 | PA | <25 | -51 | 98 | 87 |
| AL-DP-7580 | ucccuggguuuugcuuaauTT | 365 | auuaagcaaaacccagggaTT | 366 | PA | <75 | 15 | 95 | 60 |
| AL-DP-7581 | cccuggguuuugcuuaaugTT | 367 | cauuaagcaaaacccagggTT | 368 | PA | <50 | -55 | 100 | 75 |
| AL-DP-7582 | ccuggguuuugcuuaaugcTT | 369 | gcauuaagcaaaacccaggTT | 370 | PA | <25 | 3 | 74 | 87 |
| AL-DP-7583 | ucuugguucaacuccuuccTT | 371 | ggaaggaguugaaccaagaTT | 372 | PA | <75 | 43 | 14 | 19 |
| AL-DP-7584 | cuugguucaacuccuuccuTT | 373 | aggaaggaguugaaccaagTT | 374 | PA | | -19 | 22 | 74 |

TABLE 1E-continued

Additional exemplary iRNA agents for targeting influenza virus not listed in Table 1A, C, or D, and having at least 50% target coverage (criterium 1, see Example 1) and at least 80% target efficiency (criterium 2, see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-7585 | aaacgggacucuagcauacTT | 375 | guaugcuagagucccguuuTT | 376 | PB2 | | 6 | 35 | 66 |
| AL-DP-7586 | aacgggacucuagcauacuTT | 377 | aguaugcuagagucccguuTT | 378 | PB2 | <25 | 43 | 35 | 58 |
| AL-DP-7587 | acgggacucuagcauacuuTT | 379 | aaguaugcuagagucccguTT | 380 | PB2 | <25 | 14 | 52 | 71 |
| AL-DP-7588 | cgggacucuagcauacuuaTT | 381 | uaaguaugcuagagucccgTT | 382 | PB2 | <25 | 34 | 36 | 72 |
| AL-DP-7589 | gggacucuagcauacuuacTT | 383 | guaaguaugcuagagucccTT | 384 | PB2 | | -28 | 32 | 69 |
| AL-DP-7590 | ggacucuagcauacuuacuTT | 385 | aguaaguaugcuagaguccTT | 386 | PB2 | | -10 | 36 | 75 |
| AL-DP-7591 | gacucuagcauacuuacugTT | 387 | caguaaguaugcuagagucTT | 388 | PB2 | | -20 | 22 | 61 |
| AL-DP-7592 | acucuagcauacuuacugaTT | 389 | ucaguaaguaugcuagaguTT | 390 | PB2 | <25 | -25 | 48 | 77 |
| AL-DP-7593 | cucuagcauacuuacugacTT | 391 | gucaguaaguaugcuagagTT | 392 | PB2 | <75 | -14 | 50 | 64 |
| AL-DP-7594 | ucuagcauacuuacugacaTT | 393 | ugucaguaaguaugcuagaTT | 394 | PB2 | | -40 | 9 | 44 |
| AL-DP-7595 | cuagcauacuuacugacagTT | 395 | cugucaguaaguaugcuagTT | 396 | PB2 | <25 | 59 | 48 | 66 |
| AL-DP-7596 | uagcauacuuacugacagcTT | 397 | gcugucaguaaguaugcuaTT | 398 | PB2 | | -33 | -14 | 44 |
| AL-DP-7597 | agcauacuuacugacagccTT | 399 | ggcugucaguaaguaugcuTT | 400 | PB2 | | -13 | -27 | 29 |
| AL-DP-7598 | gcauacuuacugacagccaTT | 401 | uggcugucaguaaguaugcTT | 402 | PB2 | <25 | 8 | 65 | 73 |
| AL-DP-7599 | cauacuuacugacagccagTT | 403 | cuggcugucaguaaguaugTT | 404 | PB2 | <25 | -39 | 43 | 69 |
| AL-DP-7600 | auacuuacugacagccagaTT | 405 | ucuggcugucaguaaguauTT | 406 | PB2 | <25 | -33 | 48 | 74 |
| AL-DP-7601 | uacuuacugacagccagacTT | 407 | gucuggcugucaguaaguaTT | 408 | PB2 | | -28 | -40 | 35 |
| AL-DP-7602 | acuuacugacagccagacaTT | 409 | ugucuggcugucaguaaguTT | 410 | PB2 | | 6 | 17 | 60 |
| AL-DP-7603 | cuuacugacagccagacagTT | 411 | cugucuggcugucaguaagTT | 412 | PB2 | <25 | 16 | 73 | 77 |
| AL-DP-7604 | uuacugacagccagacagcTT | 413 | gcugucuggcugucaguaaTT | 414 | PB2 | | 18 | -26 | 37 |
| AL-DP-7605 | uacugacagccagacagcgTT | 415 | cgcugucuggcugucaguaTT | 416 | PB2 | | 20 | -133 | 41 |

TABLE 1E-continued

Additional exemplary iRNA agents for targeting influenza virus not listed in Table 1A, C, or D, and having at least 50% target coverage (criterium 1, see Example 1) and at least 80% target efficiency (criterium 2, see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-7606 | acugacagccagacagcgaTT | 417 | ucgcugucuggcugucaguTT | 418 | PB2 | <25 | 34 | 0 | 80 |
| AL-DP-7607 | cugacagccagacagcgacTT | 419 | gucgcugucuggcugucagTT | 420 | PB2 | <25 | 38 | 51 | 74 |
| AL-DP-7608 | ugacagccagacagcgaccTT | 421 | ggucgcugucuggcugucaTT | 422 | PB2 | <25 | 64 | -155 | 34 |
| AL-DP-7609 | gacagccagacagcgaccaTT | 423 | uggucgcugucuggcugucTT | 424 | PB2 | <25 | 88 | -16 | 71 |
| AL-DP-7610 | acagccagacagcgaccaaTT | 425 | uuggucgcugucuggcuguTT | 426 | PB2 | <25 | 55 | 29 | 72 |
| AL-DP-7611 | cagccagacagcgaccaaaTT | 427 | uuuggucgcugucuggcugTT | 428 | PB2 | <25 | 33 | 88 | 78 |
| AL-DP-7612 | agccagacagcgaccaaaaTT | 429 | uuuuggucgcugucuggcuTT | 430 | PB2 | <25 | 37 | 73 | 74 |
| AL-DP-7613 | gccagacagcgaccaaaagTT | 431 | cuuuuggucgcugucuggcTT | 432 | PB2 | <25 | 57 | -4 | 79 |
| AL-DP-7615 | cccgaucgugccuuccuuuTT | 433 | aaaggaaggcacgaucgggTT | 434 | NP | | 17 | -80 | 35 |
| AL-DP-7616 | ccgaucgugccuuccuuugTT | 435 | caaaggaaggcacgaucggTT | 436 | NP | | 11 | -40 | 47 |
| AL-DP-7617 | cgaucgugccuuccuuugaTT | 437 | ucaaaggaaggcacgaucgTT | 438 | NP | | 22 | -81 | 47 |
| AL-DP-7618 | gaucgugccuuccuuugacTT | 439 | gucaaaggaaggcacgaucTT | 440 | NP | <25 | 87 | 86 | 73 |
| AL-DP-7619 | aucgugccuuccuuugacaTT | 441 | ugucaaaggaaggcacgauTT | 442 | NP | <25 | 86 | 82 | 50 |
| AL-DP-7620 | ucgugccuuccuuugacauTT | 443 | augucaaaggaaggcacgaTT | 444 | NP | <25 | 3 | 43 | 53 |
| AL-DP-7621 | cgugccuuccuuugacaugTT | 445 | caugucaaaggaaggcacgTT | 446 | NP | | -22 | 7 | 47 |
| AL-DP-7622 | gugccuuccuuugacaugaTT | 447 | ucaugucaaaggaaggcacTT | 448 | NP | <25 | 17 | 78 | 53 |
| AL-DP-7623 | ggaucuuauuucuucggagTT | 449 | cuccgaagaaauaagauccTT | 450 | NP | <25 | 66 | 95 | 58 |
| AL-DP-7624 | gaucuuauuucuucggagaTT | 451 | ucuccgaagaaauaagaucTT | 452 | NP | <25 | 95 | 96 | 75 |
| AL-DP-7625 | aucuuauuucuucggagacTT | 453 | gucuccgaagaaauaagauTT | 454 | NP | <25 | 33 | 78 | 77 |
| AL-DP-7626 | ucuuauuucuucggagacaTT | 455 | ugucuccgaagaaauaagaTT | 456 | NP | | 8 | 17 | 7 |
| AL-DP-7627 | cuuauuucuucggagacaaTT | 457 | uugucuccgaagaaauaagTT | 458 | NP | <25 | 32 | 66 | 54 |

TABLE 1E-continued

Additional exemplary iRNA agents for targeting influenza virus not listed in Table 1A, C, or D, and having at least 50% target coverage (criterium 1, see Example 1) and at least 80% target efficiency (criterium 2, see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-7628 | uuauuucuucggagacaauTT | 459 | auugucuccgaagaaauaaTT | 460 | NP | <25 | 24 | 81 | 72 |
| AL-DP-7629 | auuucuucggagacaaugcTT | 461 | gcauugucuccgaagaaauTT | 462 | NP | <50 | 11 | 44 | 61 |
| AL-DP-7630 | gggcggggagucuucgagcTT | 463 | gcucgaagacuccccgcccTT | 464 | NP | | 15 | 24 | 9 |
| AL-DP-7631 | ggcggggagucuucgagcuTT | 465 | agcucgaagacuccccgccTT | 466 | NP | | 5 | 33 | 30 |
| AL-DP-7632 | gcggggagucuucgagcucTT | 467 | gagcucgaagacuccccgcTT | 468 | NP | <25 | 16 | 41 | 33 |
| AL-DP-7633 | cggggagucuucgagcucuTT | 469 | agagcucgaagacuccccgTT | 470 | NP | <25 | 33 | 55 | 50 |
| AL-DP-7634 | ggggagucuucgagcucucTT | 471 | gagagcucgaagacuccccTT | 472 | NP | <25 | 41 | 82 | 44 |
| AL-DP-7680 | ugacgauggucauuuugucTT | 473 | gacaaaaugaccaucgucaTT | 474 | MP | <25 | 58 | 72 | 49 |
| AL-DP-7681 | gacgauggucauuuugucaTT | 475 | ugacaaaaugaccaucgucTT | 476 | MP | | -1 | 23 | |
| AL-DP-7682 | ucccgucaggcccccucaaTT | 477 | uugagggggccugacgggaTT | 478 | MP | | -12 | 36 | |
| AL-DP-7683 | cccgucaggcccccucaaaTT | 479 | uuugagggggccugacgggTT | 480 | MP | | -4 | 14 | |
| AL-DP-8102 | ugagucuucuaaccgagguTT | 481 | accucgguuagaagacucaTT | 482 | MP | | | | |
| AL-DP-8103 | gagucuucuaaccgaggucTT | 483 | gaccucgguuagaagacucTT | 484 | MP | | | | |
| AL-DP-8104 | agucuucuaaccgaggucgTT | 485 | cgaccucgguuagaagacuTT | 486 | MP | | | | |
| AL-DP-8107 | auuguggauucuugaucguTT | 487 | acgaucaagaauccacaauTT | 488 | MP | | | | |
| AL-DP-8108 | uggauucuugaucgucuuuTT | 489 | aaagacgaucaagaauccaTT | 490 | MP | | | | |
| AL-DP-8109 | gauucuugaucgucuuuucTT | 491 | gaaaagacgaucaagaaucTT | 492 | MP | | | | |
| AL-DP-8110 | auucuugaucgucuuuucuTT | 493 | agaaaagacgaucaagaauTT | 494 | MP | | | | |
| AL-DP-8111 | uucuugaucgucuuuucuuTT | 495 | aagaaaagacgaucaagaaTT | 496 | MP | | | | |
| AL-DP-8112 | ucuugaucgucuuuucuucTT | 497 | gaagaaaagacgaucaagaTT | 498 | MP | | | | |
| AL-DP-8113 | cuugaucgucuuuucuucaTT | 499 | ugaagaaaagacgaucaagTT | 500 | MP | | | | |

TABLE 1E-continued

Additional exemplary iRNA agents for targeting influenza virus not listed in Table 1A, C, or D, and having at least 50% target coverage (criterium 1, see Example 1) and at least 80% target efficiency (criterium 2, see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-8114 | uugaucgucuuuucuucaaTT | 501 | uugaagaaaagacgaucaaTT | 502 | MP | | | | |
| AL-DP-8115 | ugaucgucuuuucuucaaaTT | 503 | uuugaagaaaagacgaucaTT | 504 | MP | | | | |
| AL-DP-8116 | gaucgucuuuucuucaaauTT | 505 | auuugaagaaaagacgaucTT | 506 | MP | | | | |
| AL-DP-8117 | aucgucuuuucuucaaaugTT | 507 | cauuugaagaaaagacgauTT | 508 | MP | | | | |
| AL-DP-8118 | ucgucuuuucuucaaaugcTT | 509 | gcauuugaagaaaagacgaTT | 510 | MP | | | | |
| AL-DP-8119 | cgucuuuucuucaaaugcaTT | 511 | ugcauuugaagaaaagacgTT | 512 | MP | | | | |
| AL-DP-8120 | gucuuuucuucaaaugcauTT | 513 | augcauuugaagaaaagacTT | 514 | MP | | | | |
| AL-DP-8121 | ucuuuucuucaaaugcauuTT | 515 | aaugcauuugaagaaaagaTT | 516 | MP | | | | |
| AL-DP-8122 | cuuuucuucaaaugcauuuTT | 517 | aaaugcauuugaagaaaagTT | 518 | MP | | | | |
| AL-DP-8123 | uuuucuucaaaugcauuuaTT | 519 | uaaaugcauuugaagaaaaTT | 520 | MP | | | | |
| AL-DP-8124 | uuucuucaaaugcauuuauTT | 521 | auaaaugcauuugaagaaaTT | 522 | MP | | | | |
| AL-DP-8125 | uucuucaaaugcauuuaucTT | 523 | gauaaaugcauuugaagaaTT | 524 | MP | | | | |
| AL-DP-8126 | ucuucaaaugcauuuaucgTT | 525 | cgauaaaugcauuugaagaTT | 526 | MP | | | | |
| AL-DP-8127 | cuucaaaugcauuuaucguTT | 527 | acgauaaaugcauuugaagTT | 528 | MP | | | | |
| AL-DP-8128 | uucaaaugcauuuaucgucTT | 529 | gacgauaaaugcauuugaaTT | 530 | MP | | | | |
| AL-DP-8129 | uuaaauacgguuugaaaagTT | 531 | cuuuucaaaccguauuuaaTT | 532 | MP | | | | |
| AL-DP-8130 | uaaauacgguuugaaaagaTT | 533 | ucuuuucaaaccguauuuaTT | 534 | MP | | | | |
| AL-DP-8131 | aaauacgguuugaaaagagTT | 535 | cucuuuucaaaccguauuuTT | 536 | MP | | | | |
| AL-DP-8132 | aauacgguuugaaaagaggTT | 537 | ccucuuuucaaaccguauuTT | 538 | MP | | | | |
| AL-DP-8133 | uugaaaagagggccuucuaTT | 539 | uagaaggcccucuuuucaaTT | 540 | MP | | | | |
| AL-DP-8134 | ugaaaagagggccuucuacTT | 541 | guagaaggcccucuuuucaTT | 542 | MP | | | | |
| AL-DP-8135 | gaaaagagggccuucuacgTT | 543 | cguagaaggcccucuuuucTT | 544 | MP | | | | |

TABLE 1E-continued

Additional exemplary iRNA agents for targeting influenza virus not listed in Table 1A, C, or D, and having at least 50% target coverage (criterium 1, see Example 1) and at least 80% target efficiency (criterium 2, see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-8136 | ccugagucuaugagggaagTT | 545 | cuucccucauagacucaggTT | 546 | MP | | | | |
| AL-DP-8137 | cugagucuaugagggaagaTT | 547 | ucuucccucauagacucagTT | 548 | MP | | | | |
| AL-DP-8138 | ugcuguggauguugacgauTT | 549 | aucgucaacauccacagcaTT | 550 | MP | | | | |
| AL-DP-8139 | gcuguggauguugacgaugTT | 551 | caucgucaacauccacagcTT | 552 | MP | | | | |
| AL-DP-8140 | cuguggauguugacgauggTT | 553 | ccaucgucaacauccacagTT | 554 | MP | | | | |
| AL-DP-8141 | uguggauguugacgaugguTT | 555 | accaucgucaacauccacaTT | 556 | MP | | | | |
| AL-DP-8142 | guggauguugacgauggucTT | 557 | gaccaucgucaacauccacTT | 558 | MP | | | | |
| AL-DP-8143 | uggauguugacgauggucaTT | 559 | ugaccaucgucaacauccaTT | 560 | MP | | | | |
| AL-DP-8144 | ggauguugacgauggucauTT | 561 | augaccaucgucaacauccTT | 562 | MP | | | | |
| AL-DP-8145 | gauguugacgauggucauuTT | 563 | aaugaccaucgucaacaucTT | 564 | MP | | | | |
| AL-DP-8146 | auguugacgauggucauuuTT | 565 | aaaugaccaucgucaacauTT | 566 | MP | | | | |
| AL-DP-8147 | uguugacgauggucauuuuTT | 567 | aaaaugaccaucgucaacaTT | 568 | MP | | | | |
| AL-DP-8148 | guugacgauggucauuuugTT | 569 | caaaaugaccaucgucaacTT | 570 | MP | | | | |
| AL-DP-8149 | uugacgauggucauuuuguTT | 571 | acaaaaugaccaucgucaaTT | 572 | MP | | | | |
| AL-DP-8152 | acgauggucauuuugucaaTT | 573 | uugacaaaaugaccaucguTT | 574 | MP | | | | |
| AL-DP-8153 | cgauggucauuuugucaacTT | 575 | guugacaaaaugaccaucgTT | 576 | MP | | | | |
| AL-DP-8154 | gauggucauuuugucaacaTT | 577 | uguugacaaaaugaccaucTT | 578 | MP | | | | |
| AL-DP-8155 | auggucauuuugucaacauTT | 579 | auguugacaaaaugaccauTT | 580 | MP | | | | |
| AL-DP-8156 | uggucauuuugucaacauaTT | 581 | uauguugacaaaaugaccaTT | 582 | MP | | | | |
| AL-DP-8157 | ggucauuuugucaacauagTT | 583 | cuauguugacaaaaugaccTT | 584 | MP | | | | |
| AL-DP-8158 | gucauuuugucaacauagaTT | 585 | ucuauguugacaaaaugacTT | 586 | MP | | | | |

TABLE 1E-continued

Additional exemplary iRNA agents for targeting influenza virus not listed in Table 1A, C, or D, and having at least 50% target coverage (criterium 1, see Example 1) and at least 80% target efficiency (criterium 2, see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-8159 | ucaaggcaccaaacgaucuTT | 587 | agaucguuuggugccuugaTT | 588 | NP | | | | |
| AL-DP-8160 | caaggcaccaaacgaucuuTT | 589 | aagaucguuuggugccuugTT | 590 | NP | | | | |
| AL-DP-8161 | aaggcaccaaacgaucuuaTT | 591 | uaagaucguuuggugccuuTT | 592 | NP | | | | |
| AL-DP-8162 | aacagcauaacaauagagaTT | 593 | ucucuauuguuaugcuguuTT | 594 | NP | | | | |
| AL-DP-8163 | acagcauaacaauagagagTT | 595 | cucucuauuguuaugcuguTT | 596 | NP | | | | |
| AL-DP-8164 | cagcauaacaauagagagaTT | 597 | ucucucuauuguuaugcugTT | 598 | NP | | | | |
| AL-DP-8165 | agcauaacaauagagagaaTT | 599 | uucucucuauuguuaugcuTT | 600 | NP | | | | |
| AL-DP-8166 | gcauaacaauagagagaauTT | 601 | auucucucuauuguuaugcTT | 602 | NP | | | | |
| AL-DP-8167 | cauaacaauagagagaaugTT | 603 | cauucucucuauuguuaugTT | 604 | NP | | | | |
| AL-DP-8168 | auugcauaugagagaauguTT | 605 | acauucucucauaugcaauTT | 606 | NP | | | | |
| AL-DP-8169 | uugcauaugagagaaugugTT | 607 | cacauucucucauaugcaaTT | 608 | NP | | | | |
| AL-DP-8170 | gcauaugagagaaugugcaTT | 609 | ugcacauucucucauaugcTT | 610 | NP | | | | |
| AL-DP-8171 | cauaugagagaaugugcaaTT | 611 | uugcacauucucucauaugTT | 612 | NP | | | | |
| AL-DP-8177 | gggagucuucgagcucucgTT | 613 | cgagagcucgaagacucccTT | 614 | NP | | | | |
| AL-DP-8178 | ggagucuucgagcucucggTT | 615 | ccgagagcucgaagacuccTT | 616 | NP | | | | |
| AL-DP-8179 | gagucuucgagcucucggaTT | 617 | uccgagagcucgaagacucTT | 618 | NP | | | | |
| AL-DP-8180 | agucuucgagcucucggacTT | 619 | guccgagagcucgaagacuTT | 620 | NP | | | | |
| AL-DP-8181 | gucuucgagcucucggacgTT | 621 | cguccgagagcucgaagacTT | 622 | NP | | | | |
| AL-DP-8182 | ucuucgagcucucggacgaTT | 623 | ucguccgagagcucgaagaTT | 624 | NP | | | | |
| AL-DP-8183 | cuucgagcucucggacgaaTT | 625 | uucguccgagagcucgaagTT | 626 | NP | | | | |
| AL-DP-8184 | uucgagcucucggacgaaaTT | 627 | uuucguccgagagcucgaaTT | 628 | NP | | | | |
| AL-DP-8185 | cgagcucucggacgaaaagTT | 629 | cuuuucguccgagagcucgTT | 630 | NP | | | | |

TABLE 1E-continued

Additional exemplary iRNA agents for targeting influenza virus not listed in Table 1A, C, or D, and having at least 50% target coverage (criterium 1, see Example 1) and at least 80% target efficiency (criterium 2, see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-8186 | gagcucucggacgaaaaggTT | 631 | ccuuuucguccgagagcucTT | 632 | NP | | | | |
| AL-DP-8187 | agcucucggacgaaaaggcTT | 633 | gccuuuucguccgagagcuTT | 634 | NP | | | | |
| AL-DP-8188 | gcucucggacgaaaaggcaTT | 635 | ugccuuuucguccgagagcTT | 636 | NP | | | | |
| AL-DP-8189 | cucucggacgaaaaggcaaTT | 637 | uugccuuuucguccgagagTT | 638 | NP | | | | |
| AL-DP-8190 | ucucggacgaaaaggcaacTT | 639 | guugccuuuucguccgagaTT | 640 | NP | | | | |
| AL-DP-8191 | cucggacgaaaaggcaacgTT | 641 | cguugccuuuucguccgagTT | 642 | NP | | | | |
| AL-DP-8192 | ucggacgaaaaggcaacgaTT | 643 | ucguugccuuuucguccgaTT | 644 | NP | | | | |
| AL-DP-8193 | cggacgaaaaggcaacgaaTT | 645 | uucguugccuuuucguccgTT | 646 | NP | | | | |
| AL-DP-8194 | ggacgaaaaggcaacgaacTT | 647 | guucguugccuuuucguccTT | 648 | NP | | | | |
| AL-DP-8195 | gacgaaaaggcaacgaaccTT | 649 | gguucguugccuuuucgucTT | 650 | NP | | | | |
| AL-DP-8196 | acgaaaaggcaacgaacccTT | 651 | ggguucguugccuuuucguTT | 652 | NP | | | | |
| AL-DP-8197 | cgaaaaggcaacgaacccgTT | 653 | cggguucguugccuuuucgTT | 654 | NP | | | | |
| AL-DP-8198 | aaaaggcaacgaacccgauTT | 655 | aucggguucguugccuuuuTT | 656 | NP | | | | |
| AL-DP-8199 | aaaggcaacgaacccgaucTT | 657 | gaucggguucguugccuuuTT | 658 | NP | | | | |
| AL-DP-8200 | aaggcaacgaacccgaucgTT | 659 | cgaucggguucguugccuuTT | 660 | NP | | | | |
| AL-DP-8201 | acgaacccgaucgugccuuTT | 661 | aaggcacgaucggguucguTT | 662 | NP | | | | |
| AL-DP-8202 | cgaacccgaucgugccuucTT | 663 | gaaggcacgaucggguucgTT | 664 | NP | | | | |
| AL-DP-8203 | gaacccgaucgugccuuccTT | 665 | ggaaggcacgaucggguucTT | 666 | NP | | | | |
| AL-DP-8204 | aacccgaucgugccuuccuTT | 667 | aggaaggcacgaucggguuTT | 668 | NP | | | | |
| AL-DP-8205 | acccgaucgugccuuccuuTT | 669 | aaggaaggcacgaucggguTT | 670 | NP | | | | |
| AL-DP-8221 | auggaugucaauccgacuuTT | 671 | aagucggauugacauccauTT | 672 | PB1 | | | | |

TABLE 1E-continued

Additional exemplary iRNA agents for targeting influenza virus not listed in Table 1A, C, or D, and having at least 50% target coverage (criterium 1, see Example 1) and at least 80% target efficiency (criterium 2, see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-8222 | uggaugucaauccgacuuuTT | 673 | aaagucggauugacauccaTT | 674 | PB1 | | | | |
| AL-DP-8223 | gaugucaauccgacuuuacTT | 675 | guaaagucggauugacaucTT | 676 | PB1 | | | | |
| AL-DP-8224 | augucaauccgacuuuacuTT | 677 | aguaaagucggauugacauTT | 678 | PB1 | | | | |
| AL-DP-8225 | ugucaauccgacuuuacuuTT | 679 | aaguaaagucggauugacaTT | 680 | PB1 | | | | |
| AL-DP-8226 | ccauacagccauggaacagTT | 681 | cuguuccauggcuguauggTT | 682 | PB1 | | | | |
| AL-DP-8227 | cauacagccauggaacaggTT | 683 | ccuguuccauggcuguaugTT | 684 | PB1 | | | | |
| AL-DP-8228 | acaggauacaccauggacaTT | 685 | uguccaugguguauccuguTT | 686 | PB1 | | | | |
| AL-DP-8229 | caggauacaccauggacacTT | 687 | guguccaugguguauccugTT | 688 | PB1 | | | | |
| AL-DP-8230 | uuggaagcaauggcuuuccTT | 689 | ggaaagccauugcuuccaaTT | 690 | PB1 | | | | |
| AL-DP-8231 | ggaagcaauggcuuuccuuTT | 691 | aaggaaagccauugcuuccTT | 692 | PB1 | | | | |
| AL-DP-8232 | agcaauggcuuuccuugaaTT | 693 | uucaaggaaagccauugcuTT | 694 | PB1 | | | | |
| AL-DP-8233 | augaugacuaacucacaagTT | 695 | cuugugaguuagucaucauTT | 696 | PB1 | | | | |
| AL-DP-8234 | ugaugacuaacucacaagaTT | 697 | ucuugugaguuagucaucaTT | 698 | PB1 | | | | |
| AL-DP-8235 | accaaauggaaugagaaucTT | 699 | gauucucauuccauuugguTT | 700 | PB1 | | | | |
| AL-DP-8236 | ccaaauggaaugagaaucaTT | 701 | ugauucucauuccauuuggTT | 702 | PB1 | | | | |
| AL-DP-8237 | ggaaugaugaugggcauguTT | 703 | acaugcccaucaucauuccTT | 704 | PB1 | | | | |
| AL-DP-8238 | gaaugaugaugggcauguuTT | 705 | aacaugcccaucaucauucTT | 706 | PB1 | | | | |
| AL-DP-8239 | cuccaauccucugaugauuTT | 707 | aaucaucagaggauuggagTT | 708 | PB1 | | | | |
| AL-DP-8240 | uccaauccucugaugauuuTT | 709 | aaaucaucagaggauuggaTT | 710 | PB1 | | | | |
| AL-DP-8241 | aucaugagggaauacaagcTT | 711 | gcuuguauucccucaugauTT | 712 | PB1 | | | | |
| AL-DP-8242 | uuugugcgacaaugcuucaTT | 713 | ugaagcauugucgcacaaaTT | 714 | PA | | | | |
| AL-DP-8243 | uaugggauuccuuucgucaTT | 715 | ugacgaaaggaaucccauaTT | 716 | PA | | | | |

TABLE 1E-continued

Additional exemplary iRNA agents for targeting influenza virus not listed in Table 1A, C, or D, and having at least 50% target coverage (criterium 1, see Example 1) and at least 80% target efficiency (criterium 2, see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-8244 | uccgagagaggcgaagagaTT | 717 | ucucuucgccucucucggaTT | 718 | PA | | | | |
| AL-DP-8245 | ccgagagaggcgaagagacTT | 719 | gucucuucgccucucucggTT | 720 | PA | | | | |
| AL-DP-8247 | gagagaggcgaagagacaaTT | 721 | uugucucuucgccucucucTT | 722 | PA | | | | |
| AL-DP-8248 | agagaggcgaagagacaauTT | 723 | auugucucuucgccucucuTT | 724 | PA | | | | |
| AL-DP-8249 | gagaggcgaagagacaauuTT | 725 | aauugucucuucgccucucTT | 726 | PA | | | | |
| AL-DP-8250 | agaggcgaagagacaauugTT | 727 | caauugucucuucgccucuTT | 728 | PA | | | | |
| AL-DP-8251 | gaggcgaagagacaauugaTT | 729 | ucaauugucucuucgccucTT | 730 | PA | | | | |
| AL-DP-8252 | aggcgaagagacaauugaaTT | 731 | uucaauugucucuucgccuTT | 732 | PA | | | | |
| AL-DP-8253 | ggcgaagagacaauugaagTT | 733 | cuucaauugucucuucgccTT | 734 | PA | | | | |
| AL-DP-8254 | gcgaagagacaauugaagaTT | 735 | ucuucaauugucucuucgcTT | 736 | PA | | | | |
| AL-DP-8255 | cgaagagacaauugaagaaTT | 737 | uucuucaauugucucuucgTT | 738 | PA | | | | |
| AL-DP-8257 | uucuccagccuugaaaacuTT | 739 | aguuuucaaggcuggagaaTT | 740 | PA | | | | |
| AL-DP-8258 | ucuccagccuugaaaacuuTT | 741 | aaguuuucaaggcuggagaTT | 742 | PA | | | | |
| AL-DP-8259 | cuccagccuugaaaacuuuTT | 743 | aaaguuuucaaggcuggagTT | 744 | PA | | | | |
| AL-DP-8260 | uccagccuugaaaacuuuaTT | 745 | uaaaguuuucaaggcuggaTT | 746 | PA | | | | |
| AL-DP-8261 | ccagccuugaaaacuuuagTT | 747 | cuaaaguuuucaaggcuggTT | 748 | PA | | | | |
| AL-DP-8262 | cagccuugaaaacuuuagaTT | 749 | ucuaaaguuuucaaggcugTT | 750 | PA | | | | |
| AL-DP-8263 | agccuugaaaacuuuagagTT | 751 | cucuaaaguuuucaaggcuTT | 752 | PA | | | | |
| AL-DP-8264 | gccuugaaaacuuuagagcTT | 753 | gcucuaaaguuuucaaggcTT | 754 | PA | | | | |
| AL-DP-8265 | ccuugaaaacuuuagagccTT | 755 | ggcucuaaaguuuucaaggTT | 756 | PA | | | | |
| AL-DP-8266 | cuugaaaacuuuagagccuTT | 757 | aggcucuaaaguuuucaagTT | 758 | PA | | | | |

TABLE 1E-continued

Additional exemplary iRNA agents for targeting influenza virus not listed in Table 1A, C, or D, and having at least 50% target coverage (criterium 1, see Example 1) and at least 80% target efficiency (criterium 2, see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-8267 | uugaaaacuuuagagccuaTT | 759 | uaggcucuaaaguuuucaaTT | 760 | PA | | | | |
| AL-DP-8268 | ugaaaacuuuagagccuauTT | 761 | auaggcucuaaaguuuucaTT | 762 | PA | | | | |
| AL-DP-8269 | gaaaacuuuagagccuaugTT | 763 | cauaggcucuaaaguuuucTT | 764 | PA | | | | |
| AL-DP-8270 | aaaacuuuagagccuauguTT | 765 | acauaggcucuaaaguuuuTT | 766 | PA | | | | |
| AL-DP-8271 | aaacuuuagagccuaugugTT | 767 | cacauaggcucuaaaguuuTT | 768 | PA | | | | |
| AL-DP-8272 | aacuuuagagccuauguggTT | 769 | ccacauaggcucuaaaguuTT | 770 | PA | | | | |
| AL-DP-8273 | acuuuagagccuauguggaTT | 771 | uccacauaggcucuaaaguTT | 772 | PA | | | | |
| AL-DP-8274 | cuuuagagccuauguggauTT | 773 | auccacauaggcucuaaagTT | 774 | PA | | | | |
| AL-DP-8281 | aaccgaacggcugcauugaTT | 775 | ucaaugcagccguucgguuTT | 776 | PA | | | | |
| AL-DP-8282 | accgaacggcugcauugagTT | 777 | cucaaugcagccguucgguTT | 778 | PA | | | | |
| AL-DP-8283 | ccgaacggcugcauugaggTT | 779 | ccucaaugcagccguucggTT | 780 | PA | | | | |
| AL-DP-8284 | cgaacggcugcauugagggTT | 781 | cccucaaugcagccguucgTT | 782 | PA | | | | |
| AL-DP-8285 | gaacggcugcauugagggcTT | 783 | gcccucaaugcagccguucTT | 784 | PA | | | | |
| AL-DP-8286 | aacggcugcauugagggcaTT | 785 | ugcccucaaugcagccguuTT | 786 | PA | | | | |
| AL-DP-8287 | acggcugcauugagggcaaTT | 787 | uugcccucaaugcagccguTT | 788 | PA | | | | |
| AL-DP-8288 | cggcugcauugagggcaagTT | 789 | cuugcccucaaugcagccgTT | 790 | PA | | | | |
| AL-DP-8289 | ggcugcauugagggcaagcTT | 791 | gcuugcccucaaugcagccTT | 792 | PA | | | | |
| AL-DP-8290 | gcugcauugagggcaagcuTT | 793 | agcuugcccucaaugcagcTT | 794 | PA | | | | |
| AL-DP-8291 | cugcauugagggcaagcuuTT | 795 | aagcuugcccucaaugcagTT | 796 | PA | | | | |
| AL-DP-8292 | ugcauugagggcaagcuuuTT | 797 | aaagcuugcccucaaugcaTT | 798 | PA | | | | |
| AL-DP-8293 | gcauugagggcaagcuuucTT | 799 | gaaagcuugcccucaaugcTT | 800 | PA | | | | |
| AL-DP-8294 | cauugagggcaagcuuucuTT | 801 | agaaagcuugcccucaaugTT | 802 | PA | | | | |

TABLE 1E-continued

Additional exemplary iRNA agents for targeting influenza virus not listed in Table 1A, C, or D, and having at least 50% target coverage (criterium 1, see Example 1) and at least 80% target efficiency (criterium 2, see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-8295 | auugagggcaagcuuucucTT | 803 | gagaaagcuugcccucaauTT | 804 | PA | | | | |
| AL-DP-8296 | uugagggcaagcuuucucaTT | 805 | ugagaaagcuugcccucaaTT | 806 | PA | | | | |
| AL-DP-8297 | ugagggcaagcuuucucaaTT | 807 | uugagaaagcuugcccucaTT | 808 | PA | | | | |
| AL-DP-8298 | gagggcaagcuuucucaaaTT | 809 | uuugagaaagcuugcccucTT | 810 | PA | | | | |
| AL-DP-8299 | agggcaagcuuucucaaauTT | 811 | auuugagaaagcuugcccuTT | 812 | PA | | | | |
| AL-DP-8300 | gggcaagcuuucucaaaugTT | 813 | cauuugagaaagcuugcccTT | 814 | PA | | | | |
| AL-DP-8301 | ggcaagcuuucucaaauguTT | 815 | acauuugagaaagcuugccTT | 816 | PA | | | | |
| AL-DP-8302 | gcaagcuuucucaaaugucTT | 817 | gacauuugagaaagcuugcTT | 818 | PA | | | | |
| AL-DP-8303 | augauaagcaaaugcagaaTT | 819 | uucugcauuugcuuaucauTT | 820 | PA | | | | |
| AL-DP-8304 | ugauaagcaaaugcagaacTT | 821 | guucugcauuugcuuaucaTT | 822 | PA | | | | |
| AL-DP-8305 | cuuagggacaaccuggaacTT | 823 | guuccagguugucccuaagTT | 824 | PA | | | | |
| AL-DP-8306 | uuagggacaaccuggaaccTT | 825 | gguuccagguugucccuaaTT | 826 | PA | | | | |
| AL-DP-8307 | uagggacaaccuggaaccuTT | 827 | agguuccagguugucccuaTT | 828 | PA | | | | |
| AL-DP-8308 | agggacaaccuggaaccugTT | 829 | cagguuccagguugucccuTT | 830 | PA | | | | |
| AL-DP-8309 | gggacaaccuggaaccuggTT | 831 | ccagguuccagguugucccTT | 832 | PA | | | | |
| AL-DP-8315 | agcaauugaggagugccugTT | 833 | caggcacuccucaauugcuTT | 834 | PA | | | | |
| AL-DP-8316 | gcaauugaggagugccugaTT | 835 | ucaggcacuccucaauugcTT | 836 | PA | | | | |
| AL-DP-8317 | caauugaggagugccugauTT | 837 | aucaggcacuccucaauugTT | 838 | PA | | | | |
| AL-DP-8318 | aauugaggagugccugauuTT | 839 | aaucaggcacuccucaauuTT | 840 | PA | | | | |
| AL-DP-8319 | auugaggagugccugauuaTT | 841 | uaaucaggcacuccucaauTT | 842 | PA | | | | |
| AL-DP-8320 | uugaggagugccugauuaaTT | 843 | uuaaucaggcacuccucaaTT | 844 | PA | | | | |

TABLE 1E-continued

Additional exemplary iRNA agents for targeting influenza virus not listed in Table 1A, C, or D, and having at least 50% target coverage (criterium 1, see Example 1) and at least 80% target efficiency (criterium 2, see Example 1)

| Duplex identifier | Sense strand sequence (5'-3') | SEQ ID NO: | Antisense strand sequence (5'-3') | SEQ ID NO: | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|---|---|---|---|
| AL-DP-8328 | uugguucaacuccuuccucTT | 845 | gaggaaggaguugaaccaaTT | 846 | PA | | | | |
| AL-DP-8329 | gaaugaaauggaugauggcTT | 847 | gccaucauccauuucauucTT | 848 | PB2 | | | | |
| AL-DP-8330 | ugguaaugaaacggaaacgTT | 849 | cguuuccguuucauuaccaTT | 850 | PB2 | | | | |
| AL-DP-8331 | augaaacggaaacgggacuTT | 851 | agucccguuuccguuucauTT | 852 | PB2 | | | | |
| AL-DP-8332 | ugaaacggaaacgggacucTT | 853 | gagucccguuuccguuucaTT | 854 | PB2 | | | | |
| AL-DP-8333 | gaaacggaaacgggacucuTT | 855 | agagucccguuuccguuucTT | 856 | PB2 | | | | |
| AL-DP-8334 | aaacggaaacgggacucuaTT | 857 | uagagucccguuuccguuuTT | 858 | PB2 | | | | |
| AL-DP-8335 | aacggaaacgggacucuagTT | 859 | cuagagucccguuuccguuTT | 860 | PB2 | | | | |
| AL-DP-8336 | acggaaacgggacucuagcTT | 861 | gcuagagucccguuuccguTT | 862 | PB2 | | | | |
| AL-DP-8337 | cggaaacgggacucuagcaTT | 863 | ugcuagagucccguuuccgTT | 864 | PB2 | | | | |
| AL-DP-8338 | ggaaacgggacucuagcauTT | 865 | augcuagagucccguuuccTT | 866 | PB2 | | | | |

[1] in in vitro plaque forming assay in MCDK cells as described in Example 3.1;
[2] in in vitro ELISA assay in MCDK cells as described in Example 3.2:
[3] in in vitro ELISA assay in MCDK cells as described in Example 3.2;
[4] in in vitro ELISA assay in MCDK cells as described in Example 3.2;
negative values indicate that target gene expression was enhanced in treated cells compared to controls

TABLE 1F

Exemplary iRNA agents for targeting influenza virus, and having 100% target coverage (criterium 1, see example 1) and 100% target efficiency (criterium 2, see example 1), but allowing for up to 3 universal bases in the non-seed region of the iRNA agent; x stands for the position of a universal base

| Duplex identifier | Sense strand sequence (5'-3') | SEQ ID NO: | Antisense strand sequence (5'-3') | SEQ ID NO: | Target influenza gene |
|---|---|---|---|---|---|
| AL-DP-8368 | ucxgcxgaxaugagcauugTT | 867 | caaugcucauxucxgcxgaTT | 868 | PB1 |
| AL-DP-8369 | cxgcxgaxaugagcauuggTT | 869 | ccaaugcucauxucxgcxgTT | 870 | PB1 |
| AL-DP-8370 | xaagaucugxuccaccauuTT | 871 | aaugguggaxcagaucuuxTT | 872 | PB1 |
| AL-DP-8371 | aagaucugxuccaccauugTT | 873 | caaugguggaxcagaucuuTT | 874 | PB1 |
| AL-DP-8372 | agaucugxuccaccauugxTT | 875 | xcaaugguggaxcagaucuTT | 876 | PB1 |
| AL-DP-8373 | xugaauuuxxcuuguccuuTT | 877 | aaggacaagxxaaauucaxTT | 878 | PB1 |
| AL-DP-8374 | ugaauuuxxcuuguccuucTT | 879 | gaaggacaagxxaaauucaTT | 880 | PB1 |
| AL-DP-8375 | gaauuuxxcuuguccuucxTT | 881 | xgaaggacaagxxaaauucTT | 882 | PB1 |
| AL-DP-8376 | uuguccuucxugaaaaaauTT | 883 | auuuuuucaxgaaggacaaTT | 884 | PB1 |
| AL-DP-8377 | uguccuucxugaaaaaaugTT | 885 | cauuuuuucaxgaaggacaTT | 886 | PB1 |
| AL-DP-8378 | guccuucxugaaaaaaugcTT | 887 | gcauuuuuucaxgaaggacTT | 888 | PB1 |
| AL-DP-8379 | uccuucxugaaaaaaugcxTT | 889 | xgcauuuuuucaxgaaggaTT | 890 | PB1 |
| AL-DP-8380 | aaxggxugxauugagggcaTT | 891 | ugcccucaauxcaxccxuuTT | 892 | PA |
| AL-DP-8381 | axggxugxauugagggcaaTT | 893 | uugcccucaauxcaxccxuTT | 894 | PA |
| AL-DP-8382 | xggxugxauugagggcaagTT | 895 | cuugcccucaauxcaxccxTT | 896 | PA |
| AL-DP-8383 | ggxugxauugagggcaagcTT | 897 | gcuugcccucaauxcaxccTT | 898 | PA |
| AL-DP-8384 | gxugxauugagggcaagcuTT | 899 | agcuugcccucaauxcaxcTT | 900 | PA |
| AL-DP-8385 | xugxauugagggcaagcuwTT | 901 | wagcuugcccucaauxcaxTT | 902 | PA |
| AL-DP-8386 | aaxgcuacuxuuugcuaucTT | 903 | gauagcaaaxaguagcxuuTT | 904 | PA |
| AL-DP-8387 | axgcuacuxuuugcuauccTT | 905 | ggauagcaaaxaguagcxuTT | 906 | PA |
| AL-DP-8388 | xgcuacuxuuugcuauccaTT | 907 | uggauagcaaaxaguagcxTT | 908 | PA |
| AL-DP-8389 | gcuacuxuuugcuauccauTT | 909 | auggauagcaaaxaguagcTT | 910 | PA |
| AL-DP-8390 | cuacuxuuugcuauccauaTT | 911 | uauggauagcaaaxaguagTT | 912 | PA |
| AL-DP-8391 | uacuxuuugcuauccauacTT | 913 | guauggauagcaaaxaguaTT | 914 | PA |
| AL-DP-8392 | acuxuuugcuauccauacuTT | 915 | aguauggauagcaaaxaguTT | 916 | PA |
| AL-DP-8393 | cuxuuugcuauccauacugTT | 917 | caguauggauagcaaaxagTT | 918 | PA |
| AL-DP-8394 | uxuuugcuauccauacuguTT | 919 | acaguauggauagcaaaxaTT | 920 | PA |
| AL-DP-8395 | xuuugcuauccauacugucTT | 921 | gacaguauggauagcaaaxTT | 922 | PA |
| AL-DP-8396 | uuugcuauccauacugucxTT | 923 | xgacaguauggauagcaaaTT | 924 | PA |
| AL-DP-8397 | ucggccxxcxaaagcagguTT | 925 | accugcuuuxgxxggccgaTT | 926 | PB2 |
| AL-DP-8398 | cggccxxcxaaagcaggucTT | 927 | gaccugcuuuxgxxggccgTT | 928 | PB2 |
| AL-DP-8399 | ggccxxcxaaagcaggucaTT | 929 | ugaccugcuuuxgxxggccTT | 930 | PB2 |
| AL-DP-8400 | gccxxcxaaagcaggucaaTT | 931 | uugaccugcuuuxgxxggcTT | 932 | PB2 |
| AL-DP-8401 | gacagxcagcagcgaccaTT | 933 | uggucgcugxcugxcugucTT | 934 | PB2 |
| AL-DP-8402 | acagxcagxcagcgaccaxTT | 935 | xuggucgcugxcugxcuguTT | 936 | PB2 |

TABLE 1F-continued

Exemplary iRNA agents for targeting influenza virus, and having 100% target coverage (criterium 1, see example 1) and 100% target efficiency (criterium 2, see example 1), but allowing for up to 3 universal bases in the non-seed region of the iRNA agent; x stands for the position of a universal base

| Duplex identifier | Sense strand sequence (5'-3') | SEQ ID NO: | Antisense strand sequence (5'-3') | SEQ ID NO: | Target influenza gene |
|---|---|---|---|---|---|
| AL-DP-8403 | xuxuhgaauxguuuaaaaaTT | 937 | uuuuuaaacxauuchaxaxTT | 938 | PB2 |
| AL-DP-8404 | uguxgaauxguuuaaaaacTT | 939 | guuuuuaaacxauucxacaTT | 940 | PB2 |
| AL-DP-8405 | guxgaauxguuuaaaaacsTT | 941 | sguuuuuaaacxauucxacTT | 942 | PB2 |
| AL-DP-8406 | uguuucuxxxauauggcgcTT | 943 | gcgccauauxxxagaaacaTT | 944 | PB2 |
| AL-DP-8407 | guuucuxxxauauggcgcaTT | 945 | ugcgccauauxxxagaaacTT | 946 | PB2 |
| AL-DP-8408 | uuucuxxxauauggcgcauTT | 947 | augcgccauauxxxagaaaTT | 948 | PB2 |
| AL-DP-8409 | uucuxxxauauggcgcauaTT | 949 | uaugcgccauauxxxagaaTT | 950 | PB2 |
| AL-DP-8410 | ucuxxxauauggcgcauacTT | 951 | guaugcgccauauxxxagaTT | 952 | PB2 |
| AL-DP-8411 | cuxxxauauggcgcauacuTT | 953 | aguaugcgccauauxxxagTT | 954 | PB2 |
| AL-DP-8412 | uxxxauauggcgcauacucTT | 955 | gaguaugcgccauauxxxaTT | 956 | PB2 |
| AL-DP-8413 | xxxuauggcgcauacucgTT | 957 | cgaguaugcgccauaxxxTT | 958 | PB2 |
| AL-DP-8414 | xxauauggcgcauacucggTT | 959 | ccgaguaugcgccauauxxTT | 960 | PB2 |
| AL-DP-8415 | xauauggcgcauacucgggTT | 961 | cccgaguaugcgccauauxTT | 962 | PB2 |
| AL-DP-8416 | auauggcgcauacucgggcTT | 963 | gcccgaguaugcgccauauTT | 964 | PB2 |
| AL-DP-8417 | uauggcgcauacucgggcaTT | 965 | ugcccgaguaugcgccauaTT | 966 | PB2 |
| AL-DP-8418 | auggcgcauacucgggcauTT | 967 | augcccgaguaugcgccauTT | 968 | PB2 |
| AL-DP-8419 | uggcgcauacucgggcaugTT | 969 | caugcccgaguaugcgccaTT | 970 | PB2 |
| AL-DP-8420 | ggcgcauacucgggcauguTT | 971 | acaugcccgaguaugcgccTT | 972 | PB2 |
| AL-DP-8421 | xxggcccccxcaaagccgaTT | 973 | ucggcuuugxgggggccxxTT | 974 | MP |
| AL-DP-8422 | xggcccccxcaaagccgaxTT | 975 | xucggcuuugxgggggccxTT | 976 | MP |
| AL-DP-8423 | xuuxacgcuxaccgugcccTT | 977 | gggcacgguxagcguxaaxTT | 978 | MP |
| AL-DP-8424 | uuxacgcuxaccgugcccaTT | 979 | ugggcacgguxagcguxaaTT | 980 | MP |
| AL-DP-8425 | uxacgcuxaccgugcccagTT | 981 | cugggcacgguxagcguxaTT | 982 | MP |
| AL-DP-8426 | xacgcuxaccgugcccagxTT | 983 | xcugggcacgguxagcguxTT | 984 | MP |

[1]in in vitro plaque forming assay in MCDK cells as described in Example 3.1

TABLE 1G

Exemplary iRNA agents for targeting influenza virus, and having 80% target coverage (criterium 1, see example 1) and 80% target efficiency (criterium 2, see example 1), but allowing for 1 universal base in the non-seed region of the iRNA agent; x stands for the position of a universal base

| Duplex identifier | Sense strand sequence (5'-3') | SEQ ID NO: | Antisense strand sequence (5'-3') | SEQ ID NO: | Target influenza gene |
|---|---|---|---|---|---|
| AL-DP-8427 | acguacguucucucuaucxTT | 985 | xgauagagagaacguacguTT | 986 | MP |
| AL-DP-8428 | cucucuaucxucccgucagTT | 987 | cugacgggaxgauagagagTT | 988 | MP |
| AL-DP-8429 | ucucuaucxucccgucaggTT | 989 | ccugacgggaxgauagagaTT | 990 | MP |

TABLE 1G-continued

Exemplary iRNA agents for targeting influenza virus, and having 80% target coverage (criterium 1, see example 1) and 80% target efficiency (criterium 2, see example 1), but allowing for 1 universal base in the non-seed region of the iRNA agent; x stands for the position of a universal base

| Duplex identifier | Sense strand sequence (5'-3') | SEQ ID NO: | Antisense strand sequence (5'-3') | SEQ ID NO: | Target influenza gene |
|---|---|---|---|---|---|
| AL-DP-8430 | cucuaucxucccgucaggcTT | 991 | gccugacgggaxgauagagTT | 992 | MP |
| AL-DP-8431 | ucuaucxucccgucaggccTT | 993 | ggccugacgggaxgauagaTT | 994 | MP |
| AL-DP-8432 | cuaucxucccgucaggcccTT | 995 | gggccugacgggaxgauagTT | 996 | MP |
| AL-DP-8433 | uaucxucccgucaggccccTT | 997 | ggggccugacgggaxgauaTT | 998 | MP |
| AL-DP-8434 | aucxucccgucaggcccccTT | 999 | gggggccugacgggaxgauTT | 1000 | MP |
| AL-DP-8435 | ucxucccgucaggcccccuTT | 1001 | agggggccugacgggaxgaTT | 1002 | MP |
| AL-DP-8436 | cxucccgucaggcccccucTT | 1003 | gagggggccugacgggaxgTT | 1004 | MP |
| AL-DP-8437 | xucccgucaggcccccucaTT | 1005 | ugagggggccugacgggaxTT | 1006 | MP |
| AL-DP-8438 | aagccgagaucgcgcagaxTT | 1007 | xucugcgcgaucucggcuuTT | 1008 | MP |
| AL-DP-8439 | gaucuxgaggcucucauggTT | 1009 | ccaugagagccucxagaucTT | 1010 | MP |
| AL-DP-8440 | aucuxgaggcucucauggaTT | 1011 | uccaugagagccucxagauTT | 1012 | MP |
| AL-DP-8441 | ucucauggaxuggcuaaagTT | 1013 | cuuuagccaxuccaugagaTT | 1014 | MP |
| AL-DP-8442 | cucauggaxuggcuaaagaTT | 1015 | ucuuuagccaxuccaugagTT | 1016 | MP |
| AL-DP-8443 | ucauggaxuggcuaaagacTT | 1017 | gucuuuagccaxuccaugaTT | 1018 | MP |
| AL-DP-8444 | cauggaxuggcuaaagacaTT | 1019 | ugucuuuagccaxuccaugTT | 1020 | MP |
| AL-DP-8445 | auggaxuggcuaaagacaaTT | 1021 | uugucuuuagccaxuccauTT | 1022 | MP |
| AL-DP-8446 | uggaxuggcuaaagacaagTT | 1023 | cuugucuuuagccaxuccaTT | 1024 | MP |
| AL-DP-8447 | ggaxuggcuaaagacaagaTT | 1025 | ucuugucuuuagccaxuccTT | 1026 | MP |
| AL-DP-8448 | gaxuggcuaaagacaagacTT | 1027 | gucuugucuuuagccaxucTT | 1028 | MP |
| AL-DP-8449 | axuggcuaaagacaagaccTT | 1029 | ggucuugucuuuagccaxuTT | 1030 | MP |
| AL-DP-8450 | xuggcuaaagacaagaccaTT | 1031 | uggucuugucuuuagccaxTT | 1032 | MP |
| AL-DP-8451 | ccugucaccucugacuaaxTT | 1033 | xuuagucagaggugacaggTT | 1034 | MP |
| AL-DP-8452 | uuuguxuucacgcucaccgTT | 1035 | cggugagcgugaaxacaaaTT | 1036 | MP |
| AL-DP-8453 | uuguxuucacgcucaccguTT | 1037 | acggugagcgugaaxacaaTT | 1038 | MP |
| AL-DP-8454 | uguxuucacgcucaccgugTT | 1039 | cacggugagcgugaaxacaTT | 1040 | MP |
| AL-DP-8455 | guxuucacgcucaccgugcTT | 1041 | gcacggugagcgugaaxacTT | 1042 | MP |
| AL-DP-8456 | uxuucacgcucaccgugccTT | 1043 | ggcacggugagcgugaaxaTT | 1044 | MP |
| AL-DP-8457 | xuucacgcucaccgugcccTT | 1045 | gggcacggugagcgugaaxTT | 1046 | MP |
| AL-DP-8458 | aggacugcagcguagacgxTT | 1047 | xcgucuacgcugcaguccuTT | 1048 | MP |
| AL-DP-8459 | ugxaugggucucauauacaTT | 1049 | uguauaugagacccauxcaTT | 1050 | MP |
| AL-DP-8460 | gxaugggucucauauacaaTT | 1051 | uuguauaugagacccauxcTT | 1052 | MP |
| AL-DP-8461 | xaugggucucauauacaacTT | 1053 | guuguauaugagacccauxTT | 1054 | MP |
| AL-DP-8462 | augggucucauauacaacxTT | 1055 | xguuguauaugagacccauTT | 1056 | MP |
| AL-DP-8463 | ugugccacxugugagcagaTT | 1057 | ucugcucacaxguggcacaTT | 1058 | MP |
| AL-DP-8464 | gugccacxugugagcagauTT | 1059 | aucugcucacaxguggcacTT | 1060 | MP |

TABLE 1G-continued

Exemplary iRNA agents for targeting influenza virus, and having 80% target coverage (criterium 1, see example 1) and 80% target efficiency (criterium 2, see example 1), but allowing for 1 universal base in the non-seed region of the iRNA agent; x stands for the position of a universal base

| Duplex identifier | Sense strand sequence (5'-3') | SEQ ID NO: | Antisense strand sequence (5'-3') | SEQ ID NO: | Target influenza gene |
|---|---|---|---|---|---|
| AL-DP-8465 | gccacxugugagcagauugTT | 1061 | caaucugcucacaxguggcTT | 1062 | MP |
| AL-DP-8466 | ccacxugugagcagauugcTT | 1063 | gcaaucugcucacaxguggTT | 1064 | MP |
| AL-DP-8467 | cuaggcaxauggugcaggcTT | 1065 | gccugcaccauxugccuagTT | 1066 | MP |
| AL-DP-8468 | augagxacaauugggacucTT | 1067 | gagucccaauuguxcucauTT | 1068 | MP |
| AL-DP-8469 | ugagxacaauugggacucaTT | 1069 | ugagucccaauuguxcucaTT | 1070 | MP |
| AL-DP-8470 | uuugcaggcxuaccagaaaTT | 1071 | uuucugguaxgccugcaaaTT | 1072 | MP |
| AL-DP-8471 | uugcaggcxuaccagaaacTT | 1073 | guuucugguaxgccugcaaTT | 1074 | MP |
| AL-DP-8472 | ugcaggcxuaccagaaacgTT | 1075 | cguuucugguaxgccugcaTT | 1076 | MP |
| AL-DP-8473 | augcagcgxuucaagugauTT | 1077 | aucacuugaaxcgcugcauTT | 1078 | MP |
| AL-DP-8474 | ugcagcgxuucaagugaucTT | 1079 | gaucacuugaaxcgcugcaTT | 1080 | MP |
| AL-DP-8475 | gcagcgxuucaagugauccTT | 1081 | ggaucacuugaaxcgcugcTT | 1082 | MP |
| AL-DP-8476 | cagcgxuucaagugauccuTT | 1083 | aggaucacuugaaxcgcugTT | 1084 | MP |
| AL-DP-8477 | agcgxuucaagugauccucTT | 1085 | gaggaucacuugaaxcgcuTT | 1086 | MP |
| AL-DP-8478 | gcgxuucaagugauccucuTT | 1087 | agaggaucacuugaaxcgcTT | 1088 | MP |
| AL-DP-8479 | cauugggauxuugcacuugTT | 1089 | caagugcaaxaucccaaugTT | 1090 | MP |
| AL-DP-8480 | auugggauxuugcacuugaTT | 1091 | ucaagugcaaxaucccaauTT | 1092 | MP |
| AL-DP-8481 | uugggauxuugcacuugauTT | 1093 | aucaagugcaaxaucccaaTT | 1094 | MP |
| AL-DP-8482 | ugggauxuugcacuugauaTT | 1095 | uaucaagugcaaxaucccaTT | 1096 | MP |
| AL-DP-8483 | gggauxuugcacuugauauTT | 1097 | auaucaagugcaaxaucccTT | 1098 | MP |
| AL-DP-8484 | ggauxuugcacuugauauuTT | 1099 | aauaucaagugcaaxauccTT | 1100 | MP |
| AL-DP-8485 | gauxuugcacuugauauugTT | 1101 | caauaucaagugcaaxaucTT | 1102 | MP |
| AL-DP-8486 | auxuugcacuugauauuguTT | 1103 | acaauaucaagugcaaxauTT | 1104 | MP |
| AL-DP-8487 | uxuugcacuugauauugugTT | 1105 | cacaauaucaagugcaaxaTT | 1106 | MP |
| AL-DP-8488 | xuugcacuugauauuguggTT | 1107 | ccacaauaucaagugcaaxTT | 1108 | MP |
| AL-DP-8489 | aaaugcauuuaucgucgcxTT | 1109 | xgcgacgauaaaugcauuuTT | 1110 | MP |
| AL-DP-8490 | uaucgucgcxuuaaauacgTT | 1111 | cguauuuaaxgcgacgauaTT | 1112 | MP |
| AL-DP-8491 | aucgucgcxuuaaauacggTT | 1113 | ccguauuuaaxgcgacgauTT | 1114 | MP |
| AL-DP-8492 | ucgucgcxuuaaauacgguTT | 1115 | accguauuuaaxgcgacgaTT | 1116 | MP |
| AL-DP-8493 | cgucgcxuuaaauacgguuTT | 1117 | aaccguauuuaaxgcgacgTT | 1118 | MP |
| AL-DP-8494 | gucgcxuuaaauacgguuuTT | 1119 | aaaccguauuuaaxgcgacTT | 1120 | MP |
| AL-DP-8495 | ucgcxuuaaauacgguuugTT | 1121 | caaaccguauuuaaxgcgaTT | 1122 | MP |
| AL-DP-8496 | cgcxuuaaauacgguuugaTT | 1123 | ucaaaccguauuuaaxgcgTT | 1124 | MP |
| AL-DP-8497 | gcxuuaaauacgguuugaaTT | 1125 | uucaaaccguauuuaaxgcTT | 1126 | MP |
| AL-DP-8498 | cxuuaaauacgguuugaaaTT | 1127 | uuucaaaccguauuuaaxgTT | 1128 | MP |
| AL-DP-8499 | xuuaaauacgguuugaaaaTT | 1129 | uuuucaaaccguauuuaaxTT | 1130 | MP |

TABLE 1G-continued

Exemplary iRNA agents for targeting influenza virus, and having 80% target coverage (criterium 1, see example 1) and 80% target efficiency (criterium 2, see example 1), but allowing for 1 universal base in the non-seed region of the iRNA agent; x stands for the position of a universal base

| Duplex identifier | Sense strand sequence (5'-3') | SEQ ID NO: | Antisense strand sequence (5'-3') | SEQ ID NO: | Target influenza gene |
|---|---|---|---|---|---|
| AL-DP-8500 | gguuugaaaagagggccuxTT | 1131 | xaggcccucuuuucaaaccTT | 1132 | MP |
| AL-DP-8501 | xuugaaaagagggccuucuTT | 1133 | agaaggcccucuuuucaaxTT | 1134 | MP |
| AL-DP-8502 | aaaaxagggccuucuacggTT | 1135 | ccguagaaggcccuxuuuuTT | 1136 | MP |
| AL-DP-8503 | aaagagggccuucuacggxTT | 1137 | xccguagaaggcccucuuuTT | 1138 | MP |
| AL-DP-8504 | guxccugagucuaugagggTT | 1139 | cccucauagacucaggxacTT | 1140 | MP |
| AL-DP-8505 | uxccugagucuaugagggaTT | 1141 | ucccucauagacucaggxaTT | 1142 | MP |
| AL-DP-8506 | xccugagucuaugagggaaTT | 1143 | uucccucauagacucaggxTT | 1144 | MP |
| AL-DP-8507 | ugagucuaugagggaagaxTT | 1145 | xucuucccucauagacucaTT | 1146 | MP |
| AL-DP-8508 | cagaxugcuguggauguugTT | 1147 | caacauccacagcaxucugTT | 1148 | MP |
| AL-DP-8509 | agaxugcuguggauguugaTT | 1149 | ucaacauccacagcaxucuTT | 1150 | MP |
| AL-DP-8510 | gaxugcuguggauguugacTT | 1151 | gucaacauccacagcaxucTT | 1152 | MP |
| AL-DP-8511 | axugcuguggauguugacgTT | 1153 | cgucaacauccacagcaxuTT | 1154 | MP |
| AL-DP-8512 | xugcuguggauguugacgaTT | 1155 | ucgucaacauccacagcaxTT | 1156 | MP |
| AL-DP-8513 | xucaaggcaccaaacgaucTT | 1157 | gaucguuuggugccuugaxTT | 1158 | NP |
| AL-DP-8514 | aggcaccaaacgaucuuaxTT | 1159 | xuaagaucguuuggugccuTT | 1160 | NP |
| AL-DP-8515 | uaugaxcagauggaaacugTT | 1161 | caguuuccaucugxucauaTT | 1162 | NP |
| AL-DP-8516 | augaxcagauggaaacuggTT | 1163 | ccaguuuccaucugxucauTT | 1164 | NP |
| AL-DP-8517 | ugaxcagauggaaacugguTT | 1165 | accaguuuccaucugxucaTT | 1166 | NP |
| AL-DP-8518 | gaxcagauggaaacuggugTT | 1167 | caccaguuuccaucugxucTT | 1168 | NP |
| AL-DP-8519 | axcagauggaaacugguggTT | 1169 | ccaccaguuuccaucugxuTT | 1170 | NP |
| AL-DP-8520 | aacugguggxgaacgccagTT | 1171 | cuggcguucxccaccaguuTT | 1172 | NP |
| AL-DP-8521 | acugguggxgaacgccagaTT | 1173 | ucuggcguucxccaccaguTT | 1174 | NP |
| AL-DP-8522 | cugguggxgaacgccagaaTT | 1175 | uucuggcguucxccaccagTT | 1176 | NP |
| AL-DP-8523 | ugguggxgaacgccagaauTT | 1177 | auucuggcguucxccaccaTT | 1178 | NP |
| AL-DP-8524 | gguggxgaacgccagaaugTT | 1179 | cauucuggcguucxccaccTT | 1180 | NP |
| AL-DP-8525 | guggxgaacgccagaaugcTT | 1181 | gcauucuggcguucxccacTT | 1182 | NP |
| AL-DP-8526 | ccagaaugcxacugagaucTT | 1183 | gaucucaguxgcauucuggTT | 1184 | NP |
| AL-DP-8527 | cagaaugcxacugagaucaTT | 1185 | ugaucucaguxgcauucugTT | 1186 | NP |
| AL-DP-8528 | agaaugcxacugagaucagTT | 1187 | cugaucucaguxgcauucuTT | 1188 | NP |
| AL-DP-8529 | gaugugcacxgaacucaaaTT | 1189 | uuugaguucxgugcacaucTT | 1190 | NP |
| AL-DP-8530 | augugcacxgaacucaaacTT | 1191 | guuugaguucxgugcacauTT | 1192 | NP |
| AL-DP-8531 | ugugcacxgaacucaaacuTT | 1193 | aguuugaguucxgugcacaTT | 1194 | NP |
| AL-DP-8532 | gugcacxgaacucaaacucTT | 1195 | gaguuugaguucxgugcacTT | 1196 | NP |
| AL-DP-8533 | ugcacxgaacucaaacucaTT | 1197 | ugaguuugaguucxgugcaTT | 1198 | NP |
| AL-DP-8534 | gcacxgaacucaaacucagTT | 1199 | cugaguuugaguucxgugcTT | 1200 | NP |

TABLE 1G-continued

Exemplary iRNA agents for targeting influenza virus, and having 80% target coverage (criterium 1, see example 1) and 80% target efficiency (criterium 2, see example 1), but allowing for 1 universal base in the non-seed region of the iRNA agent; x stands for the position of a universal base

| Duplex identifier | Sense strand sequence (5'-3') | SEQ ID NO: | Antisense strand sequence (5'-3') | SEQ ID NO: | Target influenza gene |
|---|---|---|---|---|---|
| AL-DP-8535 | caxaacagcauaacaauagTT | 1201 | cuauuguuaugcuguuxugTT | 1202 | NP |
| AL-DP-8536 | axaacagcauaacaauagaTT | 1203 | ucuauuguuaugcuguuxuTT | 1204 | NP |
| AL-DP-8537 | xaacagcauaacaauagagTT | 1205 | cucuauuguuaugcuguuxTT | 1206 | NP |
| AL-DP-8538 | aacaauagagagaaugguxTT | 1207 | xaccauucucucuauuguuTT | 1208 | NP |
| AL-DP-8539 | ugaugauxuggcauuccaaTT | 1209 | uuggaaugccaxaucaucaTT | 1210 | NP |
| AL-DP-8540 | augugxucucugaugcaagTT | 1211 | cuugcaucagagaxcacauTT | 1212 | NP |
| AL-DP-8541 | ugugxucucugaugcaaggTT | 1213 | ccuugcaucagagaxcacaTT | 1214 | NP |
| AL-DP-8542 | agxauugcauaugagagaaTT | 1215 | uucucucauaugcaauxcuTT | 1216 | NP |
| AL-DP-8543 | gxauugcauaugagagaauTT | 1217 | auucucucauaugcaauxcTT | 1218 | NP |
| AL-DP-8544 | xauugcauaugagagaaugTT | 1219 | cauucucucauaugcaauxTT | 1220 | NP |
| AL-DP-8545 | ugcxuaugagagaaugugcTT | 1221 | gcacauucucucauaxgcaTT | 1222 | NP |
| AL-DP-8546 | auaugagagaaugugcaaxTT | 1223 | xuugcacauucucucauauTT | 1224 | NP |
| AL-DP-8547 | uaugaxagaaugugcaacaTT | 1225 | uguugcacauucuxucauaTT | 1226 | NP |
| AL-DP-8548 | augaxagaaugugcaacauTT | 1227 | auguugcacauucuxucauTT | 1228 | NP |
| AL-DP-8549 | aaugugcaaxauccucaaaTT | 1229 | uuugaggauxuugcacauuTT | 1230 | NP |
| AL-DP-8550 | augugcaaxauccucaaagTT | 1231 | cuuugaggauxuugcacauTT | 1232 | NP |
| AL-DP-8551 | ugugcaaxauccucaaaggTT | 1233 | ccuuugaggauxuugcacaTT | 1234 | NP |
| AL-DP-8552 | agggaaauuxcaaacagcaTT | 1235 | ugcuguuugxaauuucccuTT | 1236 | NP |
| AL-DP-8553 | gggaaauuxcaaacagcagTT | 1237 | cugcuguuugxaauuucccTT | 1238 | NP |
| AL-DP-8554 | ggaaauuxcaaacagcagcTT | 1239 | gcugcuguuugxaauuuccTT | 1240 | NP |
| AL-DP-8555 | gaaauuxcaaacagcagcaTT | 1241 | ugcugcuguuugxaauuucTT | 1242 | NP |
| AL-DP-8556 | aaauuxcaaacagcagcacTT | 1243 | gugcugcuguuugxaauuuTT | 1244 | NP |
| AL-DP-8557 | aauuxcaaacagcagcacaTT | 1245 | ugugcugcuguuugxaauuTT | 1246 | NP |
| AL-DP-8558 | auuxcaaacagcagcacaaTT | 1247 | uugugcugcuguuugxaauTT | 1248 | NP |
| AL-DP-8559 | gcacaaxgagcaaugauggTT | 1249 | ccaucauugcucxuugugcTT | 1250 | NP |
| AL-DP-8560 | cacaaxgagcaaugauggaTT | 1251 | uccaucauugcucxuugugTT | 1252 | NP |
| AL-DP-8561 | acauucccxuauacuggagTT | 1253 | cuccaguauaxgggaauguTT | 1254 | PB1 |
| AL-DP-8562 | cauucccxuauacuggagaTT | 1255 | ucuccaguauaxgggaaugTT | 1256 | PB1 |
| AL-DP-8563 | ggagaxccuccauacagccTT | 1257 | ggcuguauggaggxucuccTT | 1258 | PB1 |
| AL-DP-8564 | gagaxccuccauacagccaTT | 1259 | uggcuguauggaggxucucTT | 1260 | PB1 |
| AL-DP-8565 | agaxccuccauacagccauTT | 1261 | auggcuguauggaggxucuTT | 1262 | PB1 |
| AL-DP-8566 | gaxccuccauacagccaugTT | 1263 | cauggcuguauggaggxucTT | 1264 | PB1 |
| AL-DP-8567 | ccxccauacagccauggaaTT | 1265 | uuccauggcuguauggxggTT | 1266 | PB1 |
| AL-DP-8568 | cxccauacagccauggaacTT | 1267 | guuccauggcuguauggxgTT | 1268 | PB1 |
| AL-DP-8569 | xccauacagccauggaacaTT | 1269 | uguuccauggcuguauggxTT | 1270 | PB1 |

TABLE 1G-continued

Exemplary iRNA agents for targeting influenza virus, and having 80% target coverage (criterium 1, see example 1) and 80% target efficiency (criterium 2, see example 1), but allowing for 1 universal base in the non-seed region of the iRNA agent; x stands for the position of a universal base

| Duplex identifier | Sense strand sequence (5'-3') | SEQ ID NO: | Antisense strand sequence (5'-3') | SEQ ID NO: | Target influenza gene |
|---|---|---|---|---|---|
| AL-DP-8570 | auacagccauggaacaggxTT | 1271 | xccuguuccauggcuguauTT | 1272 | PB1 |
| AL-DP-8571 | uggaacaggxacaggauacTT | 1273 | guauccuguxccuguuccaTT | 1274 | PB1 |
| AL-DP-8572 | ggaacaggxacaggauacaTT | 1275 | uguauccuguxccuguuccTT | 1276 | PB1 |
| AL-DP-8573 | gaacaggxacaggauacacTT | 1277 | guguauccuguxccuguucTT | 1278 | PB1 |
| AL-DP-8574 | aacaggxacaggauacaccTT | 1279 | gguguauccuguxccuguuTT | 1280 | PB1 |
| AL-DP-8575 | acaggxacaggauacaccaTT | 1281 | ugguguauccuguxccuguTT | 1282 | PB1 |
| AL-DP-8576 | caggxacaggauacaccauTT | 1283 | augguguauccuguxccugTT | 1284 | PB1 |
| AL-DP-8577 | aggxacaggauacaccaugTT | 1285 | caugguguauccuguxccuTT | 1286 | PB1 |
| AL-DP-8578 | ggxacaggauacaccauggTT | 1287 | ccaugguguauccuguxccTT | 1288 | PB1 |
| AL-DP-8579 | gxacaggauacaccauggaTT | 1289 | uccaugguguauccuguxcTT | 1290 | PB1 |
| AL-DP-8580 | xacaggauacaccauggacTT | 1291 | guccaugguguauccuguxTT | 1292 | PB1 |
| AL-DP-8581 | aggauacaccauggacacxTT | 1293 | xguguccaugguguauccuTT | 1294 | PB1 |
| AL-DP-8582 | acacxgucaacagaacacaTT | 1295 | uguguucuguugacxguguTT | 1296 | PB1 |
| AL-DP-8583 | guxuuggaagcaauggcuuTT | 1297 | aagccauugcuuccaaxacTT | 1298 | PB1 |
| AL-DP-8584 | uxuuggaagcaauggcuuuTT | 1299 | aaagccauugcuuccaaxaTT | 1300 | PB1 |
| AL-DP-8585 | xuuggaagcaauggcuuucTT | 1301 | gaaagccauugcuuccaaxTT | 1302 | PB1 |
| AL-DP-8586 | gcaauggcuuuccuugaaxTT | 1303 | xuucaaggaaagccauugcTT | 1304 | PB1 |
| AL-DP-8587 | caauggcxuuccuugaagaTT | 1305 | ucuucaaggaaxgccauugTT | 1306 | PB1 |
| AL-DP-8588 | ugaaaacucxugucuugaaTT | 1307 | uucaagacaxgaguuuucaTT | 1308 | PB1 |
| AL-DP-8589 | gaaaacucxugucuugaaaTT | 1309 | uuucaagacaxgaguuuucTT | 1310 | PB1 |
| AL-DP-8590 | aaaacucxugucuugaaacTT | 1311 | guuucaagacaxgaguuuuTT | 1312 | PB1 |
| AL-DP-8591 | cgccagacxuaugacuggaTT | 1313 | uccagucauaxgucuggcgTT | 1314 | PB1 |
| AL-DP-8592 | gccagacxuaugacuggacTT | 1315 | guccagucauaxgucuggcTT | 1316 | PB1 |
| AL-DP-8593 | ccagacxuaugacuggacaTT | 1317 | uguccagucauaxgucuggTT | 1318 | PB1 |
| AL-DP-8594 | caugaccaaxaaaauggucTT | 1319 | gaccauuuuxuuggucaugTT | 1320 | PB1 |
| AL-DP-8595 | augaccaaxaaaauggucaTT | 1321 | ugaccauuuuxuuggucauTT | 1322 | PB1 |
| AL-DP-8596 | ugaccaaxaaaauggucacTT | 1323 | gugaccauuuuxuuggucaTT | 1324 | PB1 |
| AL-DP-8597 | gaccaaxaaaauggucacaTT | 1325 | ugugaccauuuuxuuggucTT | 1326 | PB1 |
| AL-DP-8598 | accaaxaaaauggucacacTT | 1327 | gugugaccauuuuxuugguTT | 1328 | PB1 |
| AL-DP-8599 | ccaaxaaaauggucacacaTT | 1329 | ugugugaccauuuuxuuggTT | 1330 | PB1 |
| AL-DP-8600 | caaxaaaauggucacacaaTT | 1331 | uugugugaccauuuuxuugTT | 1332 | PB1 |
| AL-DP-8601 | axaaaauggucacacaaagTT | 1333 | cuuugugugaccauuuuxuTT | 1334 | PB1 |
| AL-DP-8602 | ugacaxugaacacaaugacTT | 1335 | gucauuguguucaxugucaTT | 1336 | PB1 |
| AL-DP-8603 | aaxaugaugacuaacucacTT | 1337 | gugaguuagucaucauxuuTT | 1338 | PB1 |
| AL-DP-8604 | axaugaugacuaacucacaTT | 1339 | ugugaguuagucaucauxuTT | 1340 | PB1 |

TABLE 1G-continued

Exemplary iRNA agents for targeting influenza virus, and having 80% target coverage (criterium 1, see example 1) and 80% target efficiency (criterium 2, see example 1), but allowing for 1 universal base in the non-seed region of the iRNA agent; x stands for the position of a universal base

| Duplex identifier | Sense strand sequence (5'-3') | SEQ ID NO: | Antisense strand sequence (5'-3') | SEQ ID NO: | Target influenza gene |
|---|---|---|---|---|---|
| AL-DP-8605 | xaugaugacuaacucacaaTT | 1341 | uugugaguuagucaucauxTT | 1342 | PB1 |
| AL-DP-8606 | gaugacuaacucacaagaxTT | 1343 | xucuugugaguuagucaucTT | 1344 | PB1 |
| AL-DP-8607 | gacaaxaccaaauggaaugTT | 1345 | cauuccauuugguxugucTT | 1346 | PB1 |
| AL-DP-8608 | acaaxaccaaauggaaugaTT | 1347 | ucauuccauuugguxuuguTT | 1348 | PB1 |
| AL-DP-8609 | caaxaccaaauggaaugagTT | 1349 | cucauuccauuugguxuugTT | 1350 | PB1 |
| AL-DP-8610 | aaxaccaaauggaaugagaTT | 1351 | ucucauuccauuugguxuuTT | 1352 | PB1 |
| AL-DP-8611 | axaccaaauggaaugagaaTT | 1353 | uucucauuccauuugguxuTT | 1354 | PB1 |
| AL-DP-8612 | xaccaaauggaaugagaauTT | 1355 | auucucauuccauuugguxTT | 1356 | PB1 |
| AL-DP-8613 | caaauggaaugagaaucaxTT | 1357 | xugauucucauuccauuugTT | 1358 | PB1 |
| AL-DP-8614 | auugcxccuauaauguucuTT | 1359 | agaacauuauaggxgcaauTT | 1360 | PB1 |
| AL-DP-8615 | uugcxccuauaauguucucTT | 1361 | gagaacauuauaggxgcaaTT | 1362 | PB1 |
| AL-DP-8616 | gcxccuauaauguucucaaTT | 1363 | uugagaacauuauaggxgcTT | 1364 | PB1 |
| AL-DP-8617 | cxccuauaauguucucaaaTT | 1365 | uuugagaacauuauaggxgTT | 1366 | PB1 |
| AL-DP-8618 | uacgxacacaaauaccagcTT | 1367 | gcugguauuugugux cguaTT | 1368 | PB1 |
| AL-DP-8619 | cgxacacaaauaccagcagTT | 1369 | cugcugguauuugugux cgTT | 1370 | PB1 |
| AL-DP-8620 | gxacacaaauaccagcagaTT | 1371 | ucugcugguauuugugux cTT | 1372 | PB1 |
| AL-DP-8621 | acacaxauaccagcagaaaTT | 1373 | uuucugcugguauxuguguTT | 1374 | PB1 |
| AL-DP-8622 | cacaxauaccagcagaaauTT | 1375 | auuucugcugguauxugugTT | 1376 | PB1 |
| AL-DP-8623 | acaaauaccxgcagaaaugTT | 1377 | cauuucugcxgguauuuguTT | 1378 | PB1 |
| AL-DP-8624 | caaauaccxgcagaaaugcTT | 1379 | gcauuucugcxgguauuugTT | 1380 | PB1 |
| AL-DP-8625 | aaauaccxgcagaaaugcuTT | 1381 | agcauuucugcxgguauuuTT | 1382 | PB1 |
| AL-DP-8626 | aauaccagcxgaaaugcuuTT | 1383 | aagcauuucxgcugguauuTT | 1384 | PB1 |
| AL-DP-8627 | auaccagcxgaaaugcuugTT | 1385 | caagcauuucxgcugguauTT | 1386 | PB1 |
| AL-DP-8628 | uaccagcxgaaaugcuugcTT | 1387 | gcaagcauuucxgcugguaTT | 1388 | PB1 |
| AL-DP-8629 | accagcxgaaaugcuugcaTT | 1389 | ugcaagcauuucxgcugguTT | 1390 | PB1 |
| AL-DP-8630 | ccagcxgaaaugcuugcaaTT | 1391 | uugcaagcauuucxgcuggTT | 1392 | PB1 |
| AL-DP-8631 | agaaaauxgagaaaauaagTT | 1393 | cuuauuuucucxauuuucuTT | 1394 | PB1 |

TABLE 1H

Exemplary iRNA agents for targeting influenza virus derived from agents listed in Table 1C by stabilization towards nucleolytic degradation by nucleotide modifications

| Duplex identifier | Corresponding unmodified duplex[1] | Sense strand sequence (5'-3') | SEQ ID NO: | Antisense strand sequence (5'-3') | SEQ ID NO: | Target influenza gene |
|---|---|---|---|---|---|---|
| AL-DP-2336 | AL-DP-2316 | cmumumcmagaumcmgaacmggumcmumaTT | 1395 | umagaccguucgaucugaagTT | 1396 | PB2 |
| AL-DP-2337 | AL-DP-2317 | cmagaumcmgaacmggumcmumaacmaTT | 1397 | uguumagaccguucgaucugTT | 1398 | PB2 |

TABLE 1H-continued

Exemplary iRNA agents for targeting influenza virus derived from agents listed in Table 1C by stabilization towards nucleolytic degradation by nucleotide modifications

| Duplex identifier | Corresponding unmodified duplex[1] | Sense strand sequence (5'-3') | SEQ ID NO: | Antisense strand sequence (5'-3') | SEQ ID NO: | Target influenza gene |
|---|---|---|---|---|---|---|
| AL-DP-2338 | AL-DP-2318 | agaumcmgaacmggumcmumaacmagTT | 1399 | cuguumagaccguucgaucuTT | 1400 | PB2 |
| AL-DP-2339 | AL-DP-2319 | cmaaaaumgcmumaumaagumacmcmaTT | 1401 | uggumacuumaumagcmauuuugTT | 1402 | PB2 |
| AL-DP-2340 | AL-DP-2320 | umumcmagaumcmgaacmggumcmumaaTT | 1403 | uumagaccguucgaucugaaTT | 1404 | PB2 |
| AL-DP-2341 | AL-DP-2321 | umacmcmacmaumumcmcmcmumumaum acmumTT | 1405 | agumaumaagggaauguggumaTT | 1406 | PB2 |
| AL-DP-2342 | AL-DP-2327 | umumumgagagagaagggumacmumTT | 1407 | agumacccuucucucucmaaaTT | 1408 | NP |
| AL-DP-2343 | AL-DP-2328 | aggcmaacmgaacmcmcmgaumcmgumTT | 1409 | acgaucggguucguumgccuTT | 1410 | NP |
| AL-DP-2344 | AL-DP-2329 | ggcmaacmgaacmcmcmgaumcmgumgTT | 1411 | cmacgaucggguucguugccTT | 1412 | NP |
| AL-DP-2345 | AL-DP-2330 | cmaacmgaacmcmcmgaumcmgumgcmcmTT | 1413 | ggcmacgaucggguucguugTT | 1414 | NP |
| AL-DP-2346 | AL-DP-2331 | gcmaacmgaacmcmcmgaumcmgumgcmTT | 1415 | gcmacgaucggguucguugcTT | 1416 | NP |
| AL-DP-2347 | AL-DP-2332 | gaaaaggcmaacmgaacmcmcmgaTT | 1417 | ucggguucguumgccuuuucTT | 1418 | NP |
| AL-DP-2352 | AL-DP-2348 | umgcmaumgaumaaaggcmagumcmcmTT | 1419 | ggacugccuuumaucmaugcmaTT | 1420 | PB2 |
| AL-DP-2353 | AL-DP-2349 | aumggggaumgaumcmggaaumaumTT | 1421 | aumauuccgaucmaucccc mauTT | 1422 | PB2 |
| AL-DP-2354 | AL-DP-2350 | umggggaumgaumcmggaaumaumumTT | 1423 | aaumauuccgaucmauccccmaTT | 1424 | PB2 |
| AL-DP-2355 | AL-DP-2351 | gaaacmgggacmumcmumagcmaumaTT | 1425 | umaugcumagagucccguuucTT | 1426 | PB2 |
| AL-DP-2369 | AL-DP-2356 | agacmumumumgumgcmgacmaaumgcmTT | 1427 | gcmauugucgcmacmaaagucuTT | 1428 | PA |
| AL-DP-2370 | AL-DP-2357 | gacmumumumgumgcmgacmaaumgcmumTT | 1429 | agcmauugucgcmacmaaagucTT | 1430 | PA |
| AL-DP-2371 | AL-DP-2358 | umcmumaumgggaumumcmcmumumum cmgumTT | 1431 | acgaaaggaaucccmaumagaTT | 1432 | PA |
| AL-DP-2372 | AL-DP-2359 | cmumaumgggaumumcmcmumumumcm gumcmTT | 1433 | gacgaaaggaaucccmaumagTT | 1434 | PA |
| AL-DP-2373 | AL-DP-2360 | aumgumggaumggaumumcmgaacmcmTT | 1435 | gguucgaauccmauccmacmauTT | 1436 | PA |
| AL-DP-2374 | AL-DP-2361 | umgumggaumggaumumcmgaacmcmgTT | 1437 | cgguucgaauccmauccmacmaTT | 1438 | PA |
| AL-DP-2375 | AL-DP-2362 | gumggaumggaumumcmgaacmcmgaTT | 1439 | ucgguucgaauccmauccmacTT | 1440 | PA |
| AL-DP-2376 | AL-DP-2363 | umggaumggaumumcmgaacmcmgaaTT | 1441 | uucgguucgaauccmauccmaTT | 1442 | PA |
| AL-DP-2377 | AL-DP-2364 | ggaumggaumumcmgaacmcmgaacmTT | 1443 | guucgguucgaauccmauccTT | 1444 | PA |
| AL-DP-2378 | AL-DP-2365 | gaumggaumumcmgaacmcmgaacmgTT | 1445 | cguucgguucgaauccmaucTT | 1446 | PA |
| AL-DP-2379 | AL-DP-2366 | aumggaumumcmgaacmcmgaacmggTT | 1447 | ccguucgguucgaauccmauTT | 1448 | PA |
| AL-DP-2380 | AL-DP-2367 | umggaumumcmgaacmcmgaacmggcmTT | 1449 | gccguucgguucgaauccmaTT | 1450 | PA |
| AL-DP-2381 | AL-DP-2368 | aumcmumcmcmacmaacmumcmgaggggTT | 1451 | ccccucgaguumgumggagauTT | 1452 | PA |

[1]duplex identifier of siRNA agent of Table 1C having an identical nucleotide sequence when nucleotide modifications are disregarded

TABLE 1I

Activity of the modified RNAi agents listed in Table 1B and H towards inhibition of influenza gene expression in the assays described in Example 3

| Duplex identifier | Target influenza gene | % remaining infectivity[1] | ELISA (MDCK cells), % inhibition[2] | ELISA (Vero cells), % inhibition[3] | Plasmid expression, % inhibition[4] |
|---|---|---|---|---|---|
| AL-DP-2289 | PB1 | 104% | 17 | −31 | |
| AL-DP-2290 | NP | 29% | −8 | −36 | 61 |
| AL-DP-2291 | NP | 34% | −28 | −30 | 5 |
| AL-DP-2292 | NP | 34% | −25 | −14 | 36 |
| AL-DP-2293 | MP | 40% | −7 | −74 | |
| AL-DP-2294 | MP | 78% | −19 | −53 | |
| AL-DP-2295 | MP | 67% | −39 | −85 | |
| AL-DP-2296 | MP | 61% | −21 | | |
| AL-DP-2297 | MP | | −15 | −27 | |
| AL-DP-2298 | MP | | −21 | 11 | |
| AL-DP-2299 | MP | | −23 | 12 | |
| AL-DP-2300 | MP | | −37 | −62 | |
| AL-DP-2301 | MP | | −13 | −62 | |
| AL-DP-2302 | MP | | −30 | −51 | |
| AL-DP-2303 | MP | | 1 | −44 | |
| AL-DP-2304 | MP | | −16 | −38 | |
| AL-DP-2305 | MP | 45% | 28 | −42 | |
| AL-DP-2306 | MP | 46% | −1 | −46 | |
| AL-DP-2307 | MP | 39% | 11 | −18 | |
| AL-DP-2308 | MP | | −5 | 15 | |
| AL-DP-2309 | MP | | 19 | −42 | |
| AL-DP-2310 | MP | | −1 | −29 | |
| AL-DP-2311 | MP | | −46 | −45 | |
| AL-DP-2312 | MP | | −66 | −31 | |
| AL-DP-2336 | PB2 | | 11 | −15 | |
| AL-DP-2337 | PB2 | | 6 | −23 | |
| AL-DP-2338 | PB2 | | 5 | 5 | |
| AL-DP-2339 | PB2 | | 33 | −38 | |
| AL-DP-2340 | PB2 | | 19 | −46 | |
| AL-DP-2341 | PB2 | | 14 | −5 | |
| AL-DP-2342 | NP | | 9 | 3 | 42 |
| AL-DP-2343 | NP | | −32 | −20 | 29 |
| AL-DP-2344 | NP | | −27 | −10 | 22 |
| AL-DP-2345 | NP | | 15 | −29 | 39 |
| AL-DP-2346 | NP | | −22 | −32 | 29 |
| AL-DP-2347 | NP | | −9 | −24 | 65 |
| AL-DP-2352 | PB2 | | 3 | 17 | 5 |
| AL-DP-2353 | PB2 | | −44 | 9 | 28 |
| AL-DP-2354 | PB2 | | −54 | −9 | 27 |
| AL-DP-2355 | PB2 | <25 | 13 | 45 | 59 |
| AL-DP-2369 | PA | <75 | 40 | 3 | 2 |
| AL-DP-2370 | PA | | 28 | 27 | 67 |
| AL-DP-2371 | PA | | 15 | −24 | 12 |
| AL-DP-2372 | PA | | 18 | −29 | 73 |
| AL-DP-2373 | PA | <25 | 37 | 27 | 71 |
| AL-DP-2374 | PA | <75 | 27 | −48 | 9 |
| AL-DP-2375 | PA | <25 | 44 | 53 | 87 |
| AL-DP-2376 | PA | | 4 | −40 | 38 |
| AL-DP-2377 | PA | <25 | 21 | 39 | 65 |
| AL-DP-2378 | PA | | −50 | −75 | 11 |
| AL-DP-2379 | PA | | −39 | −20 | 19 |
| AL-DP-2380 | PA | | 0 | −27 | 31 |
| AL-DP-2381 | PA | | −52 | −54 | 43 |

[1]in in vitro plaque forming assay in MCDK cells as described in Example 3.1;

[2]in in vitro ELISA assay in MCDK cells as described in Example 3.2;

[3]in in vitro ELISA assay in MCDK cells as described in Example 3.2;

[4]in in vitro ELISA assay in MCDK cells as described in Example 3.2;

negative values indicate that target gene expression was enhanced in treated cells compared to controls

TABLE 2

Concentration at 50% inhibition ($IC_{50}$) for selected RNAi agents of Table 1

| Duplex identifier | Target influenza gene | $IC_{50}$ (nM) |
|---|---|---|
| AL-DP-2364 | PA | 0.22 |
| AL-DP-2377 | PA | 2.15 |
| AL-DP-7595 | PB2 | 0.54 |
| AL-DP-7611 | PB2 | 0.075 |
| AL-DP-7617 | NP | 0.57 |
| AL-DP-7622 | NP | 0.74 |
| AL-DP-7633 | NP | ~90 |
| AL-DP-7660 | M | 261 |
| AL-DP-7669 | M | 0.79 |

The antisense strand of an iRNA agent should be equal to or at least, 14, 15, 16 17, 18, 19, 25, 29, 40, or 50 nucleotides in length. It should be equal to or less than 60, 50, 40, or 30, nucleotides in length. Preferred ranges are 15-30, 17 to 25, 19 to 23, and 19 to 21 nucleotides in length.

The sense strand of an iRNA agent should be equal to or at least 14, 15, 16 17, 18, 19, 25, 29, 40, or 50 nucleotides in length. It should be equal to or less than 60, 50, 40, or 30 nucleotides in length. Preferred ranges are 15-30, 17 to 25, 19 to 23, and 19 to 21 nucleotides in length.

The double stranded portion of an iRNA agent should be equal to or at least, 15, 16 17, 18, 19, 20, 21, 22, 23, 24, 25, 29, 40, or 50 nucleotide pairs in length. It should be equal to or less than 60, 50, 40, or 30 nucleotides pairs in length. Preferred ranges are 15-30, 17 to 25, 19 to 23, and 19 to 21 nucleotides pairs in length.

Generally, the iRNA agents of the instant invention include a region of sufficient complementarity to the respective influenza virus gene, and are of sufficient length in terms of nucleotides, that the iRNA agent, or a fragment thereof, can mediate down regulation of the influenza virus gene. It is not necessary that there be perfect complementarity between the iRNA agent and the target gene, but the correspondence must be sufficient to enable the iRNA agent, or a cleavage product thereof, to direct sequence specific silencing, e.g., by RNAi cleavage of an influenza virus RNA.

Therefore, the iRNA agents of the instant invention include agents comprising a sense strand and antisense strand each comprising a sequence of at least 16, 17 or 18 nucleotides which is essentially identical, as defined below, to one of the sequences of Tables 1A-1H, except that not more than 1, 2 or 3 nucleotides per strand, respectively, have been substituted by other nucleotides (e.g. adenosine replaced by uracil), while essentially retaining the ability to inhibit influenza virus replication in cultured human cells infeceted with influenza virus, respectively. These agents will therefore possess at least 15 nucleotides identical to one of the sequences of Tables 1A-1H, but 1, 2 or 3 base mismatches with respect to either the target influenza virus RNA sequence or between the sense and antisense strand are introduced. Mismatches to the target influenza virus RNA sequence, particularly in the antisense strand, are most tolerated in the terminal regions and if present are preferably in a terminal region or regions, e.g., within 6, 5, 4, or 3 nucleotides of a 5' and/or 3' terminus, most preferably within 6, 5, 4, or 3 nucleotides of the 5'-terminus of the sense strand or the 3'-terminus of the antisense strand. The sense strand need only be sufficiently complementary with the antisense strand to maintain the overall double stranded character of the molecule.

It is preferred that the sense and antisense strands be chosen such that the iRNA agent includes a single strand or unpaired region at one or both ends of the molecule. Thus, an iRNA agent contains sense and antisense strands, preferably paired to contain an overhang, e.g., one or two 5' or 3' overhangs but preferably a 3' overhang of 2-3 nucleotides. Most embodiments will have a 3' overhang. Preferred siRNA agents will have single-stranded overhangs, preferably 3' overhangs, of 1 to 4, or preferably 2 or 3 nucleotides, in length, at one or both ends of the iRNA agent. The overhangs can be the result of one strand being longer than the other, or the result of two strands of the same length being staggered. The unpaired nucleotides forming the overhang can be ribonucleotides, or they can be deoxyribonucleotides, preferably thymidine. 5'-ends are preferably phosphorylated, or they may be unphosphorylated.

Preferred lengths for the duplexed region are between 15 and 30, most preferably 18, 19, 20, 21, 22, and 23 nucleotides in length, e.g., in the siRNA agent range discussed above. siRNA agents can resemble in length and structure the natural Dicer processed products from long dsRNAs. Embodiments in which the two strands of the siRNA agent are linked, e.g., covalently linked, are also included. Hairpin, or other single strand structures which provide the required double stranded region, and preferably a 3' overhang are also within the invention.

Evaluation of Candidate iRNA Agents

As noted above, the present invention provides a system for identifying siRNAs that are useful as inhibitors of influenza virus infection and/or replication. Since, as noted above, shRNAs are processed intracellularly to produce siRNAs having duplex portions with the same sequence as the stem structure of the shRNA, the system is equally useful for identifying shRNAs that are useful as inhibitors of influenza virus infection. For purposes of description this section will refer to siRNAs, but the system also encompasses corresponding shRNAs. Specifically, the present invention demonstrates the successful preparation of siRNAs targeted to viral genes to block or inhibit viral infection and/or replication. The techniques and reagents described herein can readily be applied to design potential new siRNAs, targeted to other genes or gene regions, and tested for their activity in inhibiting influenza virus infection and/or replication as discussed herein. It is expected that influenza viruses will continue to mutate and undergo reassortment and that it may be desirable to continue to develop and test new, differently targeted siRNAs.

In various embodiments of the invention potential influenza virus inhibitors can be tested by introducing candidate siRNA(s) into cells (e.g., by exogenous administration or by introducing a vector or construct that directs endogenous synthesis of siRNA into the cell), or laboratory animals, prior to, simultaneously with, or after transfection with an influenza genome or portion thereof (e.g., within minutes, hours, or at most a few days) or prior to, simultaneously with, or after infection with influenza virus. Alternately, potential influenza virus inhibitors can be tested by introducing candidate siRNA(s) into cells or laboratory animals that are productively infected with influenza virus (i.e., cells that are producing progeny virus). The ability of the candidate siRNA(s) to reduce target transcript levels and/or to inhibit or suppress one or more aspects or features of the viral life cycle such as viral replication, pathogenicity, and/or infectivity is then assessed. For example, production of viral particles and/or production of viral proteins, etc., can be assessed either directly or indirectly using methods well known in the art.

Cells or laboratory animals to which inventive siRNA compositions have been delivered (test cells/animals) may be compared with similar or comparable cells or laboratory animals that have not received the inventive composition (control cells/animals, e.g., cells/animals that have received either no siRNA or a control siRNA such as an siRNA targeted to a non-viral transcript such as GFP). The susceptibility of the test cells/animals to influenza virus infection can be compared with the susceptibility of control cells/animals to infection. Production of viral protein(s) and/or progeny virus may be compared in the test cells/animals relative to the control cells/animals. Other indicia of viral infectivity, replication, pathogenicity, etc., can be similarly compared. Standard in vitro antiviral assays may utilize inhibition of viral plaques, viral cytopathic effect (CPE), and viral hemagglutinin or other protein, inhibition of viral yield, etc. The CPE can be determined visually and by dye uptake. See, e.g., Sidwell, R. W. and Smee, D. F, "In vitro and in vivo assay systems for study of influenza virus inhibitors" Antiviral Res 2000, 48:1. Generally, test cells/animals and control cells/animals would be from the same species and, for cells, of similar or identical cell type. For example, cells from the same cell line could be compared. When the test cell is a primary cell, typically the control cell would also be a primary cell. Typically the same influenza virus strain would be used to compare test cells/animals and control cells/animals.

For example, the ability of a candidate siRNA to inhibit influenza virus production may conveniently be determined by (i) delivering the candidate siRNA to cells (either prior to, at the same time as, or after exposure to influenza virus); (ii) assessing the production of viral hemagglutinin using a hemagglutinin assay, and (iii) comparing the amount of hemagglutinin produced in the presence of the siRNA with the amount produced in the absence of the siRNA. (The test need not include a control in which the siRNA is absent but may make use of previous information regarding the amount of hemagglutinin produced in the absence of inhibition.) A reduction in the amount of hemagglutinin strongly suggests a reduction in virus production. This assay may be used to test siRNAs that target any viral transcript and is not limited to siRNAs that target the transcript that encodes the viral hemagglutinin.

The ability of a candidate siRNA to reduce the level of the target transcript may also be assessed by measuring the amount of the target transcript using, for example, Northern blots, nuclease protection assays, reverse transcription (RT)-PCR, real-time RT-PCR, microarray analysis, etc. The ability of a candidate siRNA to inhibit production of a polypeptide encoded by the target transcript (either at the transcriptional or post-transcriptional level) may be measured using a variety of antibody-based approaches including, but not limited to, Western blots, immunoassays, ELISA, flow cytometry, protein microarrays, etc. In general, any method of measuring the amount of either the target transcript or a polypeptide encoded by the target transcript may be used.

In general, certain preferred influenza virus inhibitors reduce the target transcript level at least about 2 fold, preferably at least about 4 fold, more preferably at least about 8 fold, at least about 16 fold, at least about 64 fold or to an even greater degree relative to the level that would be present in the absence of the inhibitor (e.g., in a comparable control cell lacking the inhibitor). In general, certain preferred influenza virus inhibitors inhibit viral replication, so that the level of replication is lower in a cell containing the inhibitor than in a control cell not containing the inhibitor by at least about 2 fold, preferably at least about 4 fold, more preferably at least about 8 fold, at least about 16 fold, at least about 64 fold, at least about 100 fold, at least about 200 fold, or to an even greater degree.

Certain preferred influenza virus inhibitors inhibit viral replication so that development of detectable viral titer is prevented for at least 24 hours, at least 36 hours, at least 48 hours, or at least 60 hours following administration of the siRNA and infection of the cells. Certain preferred influenza virus inhibitors prevent (i.e., reduce to undetectable levels) or significantly reduce viral replication for at least 24 hours, at least 36 hours, at least 48 hours, or at least 60 hours following administration of the siRNA. According to various embodiments of the invention a significant reduction in viral replication is a reduction to less than approximately 90% of the level that would occur in the absence of the siRNA, a reduction to less than approximately 75% of the level that would occur in the absence of the siRNA, a reduction to less than approximately 50% of the level that would occur in the absence of the siRNA, a reduction to less than approximately 25% of the level that would occur in the absence of the siRNA, or a reduction to less than approximately 10% of the level that would occur in the absence of the siRNA. Reduction in viral replication may be measured using any suitable method including, but not limited to, measurement of HA titer.

Stability Testing, Modification, and Retesting of iRNA Agents

A candidate iRNA agent can be evaluated with respect to stability, e.g., its susceptibility to cleavage by an endonuclease or exonuclease, such as when the iRNA agent is introduced into the body of a subject. Methods can be employed to identify sites that are susceptible to modification, particularly cleavage, e.g., cleavage by a component found in the body of a subject. Such methods may include the isolation and identification of most abundant fragments formed by degradation of the candidate iRNA agent after its incubation with isolated biological media in vitro, e.g. serum, plasma, sputum, cerebrospinal fluid, or cell or tissue homogenates, or after contacting a subject with the candidate iRNA agent in vivo, thereby identifying sites prone to cleavage. Such methods are, for example, without limitation, in co-owned International Application No. PCT/US2005/018931, filed on May 27, 2005.

When sites susceptible to cleavage are identified, a further iRNA agent can be designed and/or synthesized wherein the potential cleavage site is made resistant to cleavage, e.g. by introduction of a 2'-modification on the site of cleavage, e.g. a 2'-O-methyl group. This further iRNA agent can be retested for stability, and this process may be iterated until an iRNA agent is found exhibiting the desired stability.

In Vivo Testing

An iRNA agent identified as being capable of inhibiting influenza virus gene expression can be tested for functionality in vivo in an animal model (e.g., in a mammal, such as in mouse or rat). For example, the iRNA agent can be administered to an animal, and the iRNA agent evaluated with respect to its biodistribution, stability, and its ability to inhibit influenza virus replication or reduce a biological or pathological process mediated at least in part by influenza virus.

The iRNA agent can be administered directly to the target tissue, such as by injection, or the iRNA agent can be administered to the animal model in the same manner that it would be administered to a human. Preferably, the iRNA agent is delivered to the subject's airways, such as intranasally.

The iRNA agent can also be evaluated for its intracellular distribution. The evaluation can include determining whether the iRNA agent was taken up into the cell. The evaluation can also include determining the stability (e.g., the half-life) of the iRNA agent. Evaluation of an iRNA agent in vivo can be facilitated by use of an iRNA agent conjugated to a traceable marker (e.g., a fluorescent marker such as fluorescein; a radioactive label, such as $^{35}S$, $^{32}P$, $^{33}P$, or $^{3}H$; gold particles; or antigen particles for immunohistochemistry).

The iRNA agent can be evaluated with respect to its ability to down regulate influenza virus replication. Levels of influenza virus gene expression in vivo can be measured, for example, by in situ hybridization, or by the isolation of RNA from tissue prior to and following exposure to the iRNA agent. Where the animal needs to be sacrificed in order to harvest the tissue, an untreated control animal will serve for comparison. Influenza virus RNA can be detected by any desired method, including but not limited to RT-PCR, Northern blot, branched-DNA assay, or RNAase protection assay. Alternatively, or additionally, influenza virus gene expression can be monitored by performing Western blot analysis or plaque forming assays on tissue extracts treated with the iRNA agent.

Potential influenza virus inhibitors can be tested using any of variety of animal models that have been developed. Compositions comprising candidate siRNA(s), constructs or vectors capable of directing synthesis of such siRNAs within a host cell, or cells engineered or manipulated to contain candidate siRNAs may be administered to an animal prior to, simultaneously with, or following infection with an influenza virus. The ability of the composition to prevent viral infection and/or to delay or prevent appearance of influenza-related symptoms and/or lessen their severity relative to influenza-infected animals that have not received the potential influenza inhibitor is assessed. Such models include, but are not limited to, murine, chicken, ferret, and non-human primate models for influenza infection, all of which are known in the art and are used for testing the efficacy of potential influenza therapeutics and vaccines. See, e.g, Sidwell, R. W. and Smee, D. F, referenced above. Such models may involve use of naturally occurring influenza virus strains and/or strains that have been modified or adapted to existence in a particular host (e.g., the WSN or PR8 strains, which are adapted for replication in mice). The above animal models may also be used to establish the concentration necessary to achieve a certain desired effect (e.g., EC50).

iRNA Chemistry

Described herein are isolated iRNA agents, e.g., ds RNA agents that mediate RNAi to inhibit expression of a influenza virus gene.

RNA agents discussed herein include otherwise unmodified RNA as well as RNA which has been modified, e.g., to improve efficacy, and polymers of nucleoside surrogates. Unmodified RNA refers to a molecule in which the components of the nucleic acid, namely sugars, bases, and phosphate moieties, are the same or essentially the same as that which occur in nature, preferably as occur naturally in the human body. The art has referred to rare or unusual, but naturally occurring, RNAs as modified RNAs, see, e.g., Limbach et al. *Nucleic Acids Res.* 22: 2183-2196, 1994. Such rare or unusual RNAs, often termed modified RNAs (apparently because they are typically the result of a post-transcriptional modification) are within the term unmodified RNA, as used herein. Modified RNA as used herein refers to a molecule in which one or more of the components of the nucleic acid, namely sugars, bases, and phosphate moieties, are different from that which occurs in nature, preferably different from that which occurs in the human body. While they are referred to as modified "RNAs," they will of course, because of the modification, include molecules which are not RNAs. Nucleoside surrogates are molecules in which the ribophosphate backbone is replaced with a non-ribophosphate construct that allows the bases to the presented in the correct spatial relationship such that hybridization is substantially similar to what is seen with a ribophosphate backbone, e.g., non-charged mimics of the ribophosphate backbone. Examples of the above are discussed herein.

Modifications described herein can be incorporated into any double-stranded RNA and RNA-like molecule described herein, e.g., an iRNA agent. It may be desirable to modify one or both of the antisense and sense strands of an iRNA agent. As nucleic acids are polymers of subunits or monomers, many of the modifications described below occur at a position which is repeated within a nucleic acid, e.g., a modification of a base, or a phosphate moiety, or the non-linking O of a phosphate moiety. In some cases the modification will occur at all of the subject positions in the nucleic acid but in many, and in fact in most, cases it will not. By way of example, a modification may only occur at a 3' or 5' terminal position, may only occur in a terminal region, e.g. at a position on a terminal nucleotide or in the last 2, 3, 4, 5, or 10 nucleotides of a strand. A modification may occur in a double strand region, a single strand region, or in both. E.g., a phosphorothioate modification at a non-linking O position may only occur at one or both termini, may only occur in a terminal regions, e.g., at a position on a terminal nucleotide or in the last 2, 3, 4, 5, or 10 nucleotides of a strand, or may occur in double strand and single strand regions, particularly at termini. Similarly, a modification may occur on the sense strand, antisense strand, or both. In some cases, the sense and antisense strand will have the same modifications or the same class of modifications, but in other cases the sense and antisense strand will have different modifications, e.g., in some cases it may be desirable to modify only one strand, e.g. the sense strand.

Two prime objectives for the introduction of modifications into iRNA agents is their stabilization towards degradation in biological environments and the improvement of pharmacological properties, e.g. pharmacodynamic properties, which are further discussed below. Other suitable modifications to a sugar, base, or backbone of an iRNA agent are described in co-owned PCT Application No. PCT/US2004/01193, filed Jan. 16, 2004. An iRNA agent can include a non-naturally occurring base, such as the bases described in co-owned PCT Application No. PCT/US2004/011822, filed Apr. 16, 2004. An iRNA agent can include a non-naturally occurring sugar, such as a non-carbohydrate cyclic carrier molecule. Exemplary features of non-naturally occurring sugars for use in iRNA agents are described in co-owned PCT Application No. PCT/US2004/11829, filed Apr. 16, 2003.

An iRNA agent can include an internucleotide linkage (e.g., the chiral phosphorothioate linkage) useful for increasing nuclease resistance. In addition, or in the alternative, an iRNA agent can include a ribose mimic for increased nuclease resistance. Exemplary internucleotide linkages and ribose mimics for increased nuclease resistance are described in co-owned PCT Application No. PCT/US2004/07070, filed on Mar. 8, 2004.

An iRNA agent can include ligand-conjugated monomer subunits and monomers for oligonucleotide synthesis. Exemplary monomers are described in co-owned U.S. application Ser. No. 10/916,185, filed on Aug. 10, 2004.

An iRNA agent can have a ZXY structure, such as is described in co-owned PCT Application No. PCT/US2004/07070, filed on Mar. 8, 2004.

An iRNA agent can be complexed with an amphipathic moiety. Exemplary amphipathic moieties for use with iRNA agents are described in co-owned PCT Application No. PCT/US2004/07070, filed on Mar. 8, 2004.

In another embodiment, the iRNA agent can be complexed to a delivery agent that features a modular complex. The complex can include a carrier agent linked to one or more of (preferably two or more, more preferably all three of): (a) a condensing agent (e.g., an agent capable of attracting, e.g., binding, a nucleic acid, e.g., through ionic or electrostatic interactions); (b) a fusogenic agent (e.g., an agent capable of fusing and/or being transported through a cell membrane); and (c) a targeting group, e.g., a cell or tissue targeting agent, e.g., a lectin, glycoprotein, lipid or protein, e.g., an antibody, that binds to a specified cell type. iRNA agents complexed to a delivery agent are described in co-owned PCT Application No. PCT/US2004/07070, filed on Mar. 8, 2004.

An iRNA agent can have non-canonical pairings, such as between the sense and antisense sequences of the iRNA duplex. Exemplary features of non-canonical iRNA agents are described in co-owned PCT Application No. PCT/US2004/07070, filed on Mar. 8, 2004.

Enhanced Nuclease Resistance

An iRNA agent, e.g., an iRNA agent that targets influenza virus, can have enhanced resistance to nucleases.

One way to increase resistance is to identify cleavage sites and modify such sites to inhibit cleavage, as described in co-owned U.S. Application No. 60/559,917, filed on May 4, 2004. For example, the dinucleotides 5'-ua-3',5'-ca-3',5'-ug-3',5'-uu-3', or 5'-cc-3' can serve as cleavage sites. In certain embodiments, all the pyrimidines of an iRNA agent carry a 2'-modification in either the sense strand, the antisense strand, or both strands, and the iRNA agent therefore has enhanced resistance to endonucleases. Enhanced nuclease resistance can also be achieved by modifying the 5' nucleotide, resulting, for example, in at least one 5'-uridine-adenine-3' (5'-ua-3') dinucleotide wherein the uridine is a 2'-modified nucleotide; at least one 5'-cytidine-adenine-3' (5'-ca-3') dinucleotide, wherein the 5'-cytidine is a 2'-modified nucleotide; at least one 5'-uridine-guanine-3' (5'-ug-3') dinucleotide, wherein the 5'-uridine is a 2'-modified nucleotide; at least one 5'-uridine-uridine-3' (5'-uu-3') dinucleotide, wherein the 5'-uridine is a 2'-modified nucleotide; or at least one 5'-cytidine-cytidine-3' (5'-cc-3') dinucleotide, wherein the 5'-cytidine is a 2'-modified nucleotide, as described in co-owned International Application No. PCT/US2005/018931, filed on May 27, 2005. The iRNA agent can include at least 2, at least 3, at least 4 or at least 5 of such dinucleotides. In a particularly preferred embodiment, the 5' nucleotide in all occurrences of the sequence motifs 5'-ua-3' and 5'-ca-3' in either the sense strand, the antisense strand, or both strands is a modified nucleotide. Preferably, the 5' nucleotide in all occurrences of the sequence motifs 5'-ua-3',5'-ca-3' and 5'-ug-3' in either the sense strand, the antisense strand, or both strands is a modified nucleotide. More preferably, all pyrimidine nucleotides in the sense strand are modified nucleotides, and the 5' nucleotide in all occurrences of the sequence motifs 5'-ua-3' and 5'-ca-3' in the antisense strand are modified nucleotides, or where the antisense strand does comprise neither of a 5'-ua-3' and a 5'-ca-3' motif, in all occurrences of the sequence motif 5'-ug-3'.

Preferably, the 2'-modified nucleotides include, for example, a 2'-modified ribose unit, e.g., the 2'-hydroxyl group (OH) can be modified or replaced with a number of different "oxy" or "deoxy" substituents.

Examples of "oxy"-2' hydroxyl group modifications include alkoxy or aryloxy (OR, e.g., R=H, alkyl, cycloalkyl, aryl, aralkyl, heteroaryl or sugar); polyethyleneglycols (PEG), $O(CH_2CH_2O)_nCH_2CH_2OR$; "locked" nucleic acids (LNA) in which the 2' hydroxyl is connected, e.g., by a methylene bridge, to the 4' carbon of the same ribose sugar; O-AMINE and aminoalkoxy, $O(CH_2)_n$AMINE, (e.g., AMINE=$NH_2$; alkylamino, dialkylamino, heterocyclyl amino, arylamino, diaryl amino, heteroaryl amino, or diheteroaryl amino, ethylene diamine, polyamino). It is noteworthy that oligonucleotides containing only the methoxyethyl group (MOE), ($OCH_2CH_2OCH_3$, a PEG derivative), exhibit nuclease stabilities comparable to those modified with the robust phosphorothioate modification.

"Deoxy" modifications include hydrogen (i.e. deoxyribose sugars, which are of particular relevance to the overhang portions of partially ds RNA); halo (e.g., fluoro); amino (e.g. $NH_2$; alkylamino, dialkylamino, heterocyclyl, arylamino, diaryl amino, heteroaryl amino, diheteroaryl amino, or amino acid); $NH(CH_2CH_2NH)_nCH_2CH_2$-AMINE (AMINE=$NH_2$; alkylamino, dialkylamino, heterocyclyl amino, arylamino, diaryl amino, heteroaryl amino, or diheteroaryl amino), —NHC(O)R(R=alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino functionality.

Preferred substitutents are 2'-methoxyethyl, 2'-$OCH_3$, 2'-O-allyl, 2'-C-allyl, and 2'-fluoro.

The inclusion of furanose sugars in the oligonucleotide backbone can also decrease endonucleolytic cleavage. An iRNA agent can be further modified by including a 3' cationic group, or by inverting the nucleoside at the 3'-terminus with a 3'-3' linkage. In another alternative, the 3'-terminus can be blocked with an aminoalkyl group, e.g., a 3' C5-aminoalkyl dT. Other 3' conjugates can inhibit 3'-5' exonucleolytic cleavage. While not being bound by theory, a 3' conjugate, such as naproxen or ibuprofen, may inhibit exonucleolytic cleavage by sterically blocking the exonuclease from binding to the 3'-end of oligonucleotide. Even small alkyl chains, aryl groups, or heterocyclic conjugates or modified sugars (D-ribose, deoxyribose, glucose etc.) can block 3'-5'-exonucleases.

Nucleolytic cleavage can also be inhibited by the introduction of phosphate linker modifications, e.g., phosphorothioate linkages. Thus, preferred iRNA agents include nucleotide dimers enriched or pure for a particular chiral form of a modified phosphate group containing a heteroatom at a nonbridging position normally occupied by oxygen. The heteroatom can be S, Se, $Nr_2$, or $Br_a$. When the heteroatom is S, enriched or chirally pure Sp linkage is preferred. Enriched means at least 70, 80, 90, 95, or 99% of the preferred form. Modified phosphate linkages are particularly efficient in inhibiting exonucleolytic cleavage when introduced near the 5'- or 3'-terminal positions, and preferably the 5'-terminal positions, of an iRNA agent.

5' conjugates can also inhibit 5'-3' exonucleolytic cleavage. While not being bound by theory, a 5' conjugate, such as naproxen or ibuprofen, may inhibit exonucleolytic cleavage by sterically blocking the exonuclease from binding to the 5'-end of oligonucleotide. Even small alkyl chains, aryl groups, or heterocyclic conjugates or modified sugars (D-ribose, deoxyribose, glucose etc.) can block 3'-5'-exonucleases.

An iRNA agent can have increased resistance to nucleases when a duplexed iRNA agent includes a single-stranded nucleotide overhang on at least one end. In preferred embodiments, the nucleotide overhang includes 1 to 4, preferably 2 to 3, unpaired nucleotides. In a preferred embodiment, the unpaired nucleotide of the single-stranded overhang that is directly adjacent to the terminal nucleotide pair contains a purine base, and the terminal nucleotide pair is a G-C pair, or at least two of the last four complementary nucleotide pairs are G-C pairs. In further embodiments, the nucleotide overhang may have 1 or 2 unpaired nucleotides, and in an exemplary embodiment the nucleotide overhang is 5'-gc-3'. In preferred embodiments, the nucleotide overhang is on the 3'-end of the antisense strand. In one embodiment, the iRNA agent includes the motif 5'-cgc-3' on the 3'-end of the antisense strand, such that a 2-nt overhang 5'-gc-3' is formed.

Thus, an iRNA agent can include modifications so as to inhibit degradation, e.g., by nucleases, e.g., endonucleases or exonucleases, found in the body of a subject. These monomers are referred to herein as NRMs, or Nuclease Resistance promoting Monomers, the corresponding modifications as NRM modifications. In many cases these modifications will modulate other properties of the iRNA agent as well, e.g., the ability to interact with a protein, e.g., a transport protein, e.g., serum albumin, or a member of the RISC, or the ability of the first and second sequences to form a duplex with one another or to form a duplex with another sequence, e.g., a target molecule.

One or more different NRM modifications can be introduced into an iRNA agent or into a sequence of an iRNA agent. An NRM modification can be used more than once in a sequence or in an iRNA agent.

NRM modifications include some which can be placed only at the terminus and others which can go at any position. Some NRM modifications can inhibit hybridization so it is preferable to use them only in terminal regions, and preferable to not use them at the cleavage site or in the cleavage region of a sequence which targets a subject sequence or gene, particularly on the antisense strand. They can be used anywhere in a sense strand, provided that sufficient hybridization between the two strands of the ds iRNA agent is maintained. In some embodiments it is desirable to put the NRM at the cleavage site or in the cleavage region of a sense strand, as it can minimize off-target silencing.

In most cases, NRM modifications will be distributed differently depending on whether they are comprised on a sense or antisense strand. If on an antisense strand, modifications which interfere with or inhibit endonuclease cleavage should not be inserted in the region which is subject to RISC mediated cleavage, e.g., the cleavage site or the cleavage region (As described in Elbashir et al., 2001, Genes and Dev. 15: 188, hereby incorporated by reference). Cleavage of the target occurs about in the middle of a 20 or 21 nt antisense strand, or about 10 or 11 nucleotides upstream of the first nucleotide on the target mRNA which is complementary to the antisense strand. As used herein cleavage site refers to the nucleotides on either side of the cleavage site, on the target or on the iRNA agent strand which hybridizes to it. Cleavage region means the nucleotides within 1, 2, or 3 nucleotides of the cleavagee site, in either direction.

Such modifications can be introduced into the terminal regions, e.g., at the terminal position or with 2, 3, 4, or 5 positions of the terminus, of a sense or antisense strand.

Tethered Ligands

The properties of an iRNA agent, including its pharmacological properties, can be influenced and tailored, for example, by the introduction of ligands, e.g. tethered ligands. In addition, pharmacological properties of an iRNA agent can be improved by incorporating a ligand in a formulation of the iRNA agent when the iRNA agent either has or does have a tethered ligand.

A wide variety of entities, e.g., ligands, can be tethered to an iRNA agent or used as formulation conjugate or additive, e.g., to the carrier of a ligand-conjugated monomer subunit. Examples are described below in the context of a ligand-conjugated monomer subunit but that is only preferred, entities can be coupled at other points to an iRNA agent.

Preferred moieties are ligands, which are coupled, preferably covalently, either directly or indirectly via an intervening tether, to the carrier. In preferred embodiments, the ligand is attached to the carrier via an intervening tether. The ligand or tethered ligand may be present on the ligand-conjugated monomer when the ligand-conjugated monomer is incorporated into the growing strand. In some embodiments, the ligand may be incorporated into a "precursor" ligand-conjugated monomer subunit after a "precursor" ligand-conjugated monomer subunit has been incorporated into the growing strand. For example, a monomer having, e.g., an amino-terminated tether, e.g., TAP-$(CH_2)_nNH_2$ may be incorporated into a growing sense or antisense strand. In a subsequent operation, i.e., after incorporation of the precursor monomer subunit into the strand, a ligand having an electrophilic group, e.g., a pentafluorophenyl ester or aldehyde group, can subsequently be attached to the precursor ligand-conjugated monomer by coupling the electrophilic group of the ligand with the terminal nucleophilic group of the precursor ligand-conjugated monomer subunit tether.

In preferred embodiments, a ligand alters the distribution, targeting or lifetime of an iRNA agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand.

Preferred ligands can improve transport, hybridization, and specificity properties and may also improve nuclease resistance of the resultant natural or modified oligoribonucleotide, or a polymeric molecule comprising any combination of monomers described herein and/or natural or modified ribonucleotides.

Ligands in general can include therapeutic modifiers, e.g., for enhancing uptake; diagnostic compounds or reporter groups e.g., for monitoring distribution; cross-linking agents; nuclease-resistance conferring moieties; and natural or unusual nucleobases. General examples include lipophilic molecules, lipids, lectins, steroids (e.g., uvaol, hecigenin, diosgenin), terpenes (e.g., triterpenes, e.g., sarsasapogenin, Friedelin, epifriedelanol derivatized lithocholic acid), vitamins, carbohydrates (e.g., a dextran, pullulan, chitin, chitosan, inulin, cyclodextrin or hyaluronic acid), proteins, protein binding agents, integrin targeting molecules, polycationics, peptides, polyamines, and peptide mimics.

The ligand may be a naturally occurring or recombinant or synthetic molecule, such as a synthetic polymer, e.g., a synthetic polyamino acid. Examples of polyamino acids include polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacrylic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic moieties, e.g., cationic lipid, cationic porphyrin, quaternary salt of a polyamine, or an alpha helical peptide.

Ligands can also include targeting groups, e.g., a cell or tissue targeting agent, e.g., a thyrotropin, melanotropin, surfactant protein A, Mucin carbohydrate, a glycosylated polyaminoacid, transferrin, bisphosphonate, polyglutamate, polyaspartate, or an RGD peptide or RGD peptide mimetic.

Ligands can be proteins, e.g., glycoproteins, lipoproteins, e.g. low density lipoprotein (LDL), or albumins, e.g. human serum albumin (HSA), or peptides, e.g., molecules having a specific affinity for a co-ligand, or antibodies e.g., an antibody, that binds to a specified cell type such as a cancer cell, endothelial cell, or bone cell. Ligands may also include hormones and hormone receptors. They can also include non-peptidic species, such as cofactors, multivalent lactose, multivalent galactose, N-acetyl-galactosamine, N-acetyl-glucosamine, multivalent mannose, or multivalent fucose. The ligand can be, for example, a lipopolysaccharide, an activator of p38 MAP kinase, or an activator of NF-κB.

The ligand can be a substance, e.g, a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In one aspect, the ligand is a lipid or lipid-based molecule. Such a lipid or lipid-based molecule preferably binds a serum protein, e.g., human serum albumin (HSA). An HSA binding ligand allows for distribution of the conjugate to a target tissue, e.g., liver tissue, including parenchymal cells of the liver. Other molecules that can bind HSA can also be used as ligands. For example, neproxin or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to modulate, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In a preferred embodiment, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another aspect, the ligand is a moiety, e.g., a vitamin or nutrient, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include the B vitamins, e.g., folic acid, B12, riboflavin, biotin, pyridoxal or other vitamins or nutrients taken up by cancer cells.

In another aspect, the ligand is a cell-permeation agent, preferably a helical cell-permeation agent. Preferably, the agent is amphipathic. An exemplary agent is a peptide such as tat or antennapedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

5'-Phosphate Modifications

In preferred embodiments, iRNA agents are 5' phosphorylated or include a phosphoryl analog at the 5' prime terminus 5'-phosphate modifications of the antisense strand include those which are compatible with RISC mediated gene silencing. Suitable modifications include: 5'-monophosphate ((HO)2(O)P—O-5'); 5'-diphosphate ((HO)2(O)P—O—P(HO)(O)—O-5'); 5'-triphosphate ((HO)2(O)P—O—(HO)(O)P—O—P(HO)(O)—O-5'); 5'-guanosine cap (7-methylated or non-methylated) (7m-G-O-5'-(HO)(O)P—O—(HO)

(O)P—O—P(HO)(O)—O-5'); 5'-adenosine cap (Appp), and any modified or unmodified nucleotide cap structure (N—O-5'-(HO)(O)P—O—(HO)(O)P—O—P(HO)(O)—O-5'); 5'-monothiophosphate (phosphorothioate; (HO)2(S)P—O-5'); 5'-monodithiophosphate (phosphorodithioate; (HO)(HS)(S)P—O-5'), 5'-phosphorothiolate ((HO)2(O)P—S-5'); any additional combination of oxygen/sulfur replaced monophosphate, diphosphate and triphosphates (e.g. 5'-alpha-thiotriphosphate, 5'-gamma-thiotriphosphate, etc.), 5'-phosphoramidates ((HO)2(O)P—NH—S', (HO)(NH2)(O)P—O—S'), 5'-alkylphosphonates (R=alkyl=methyl, ethyl, isopropyl, propyl, etc., e.g. RP(OH)(O)—O-5'-, (OH)2(O)P-5'-CH2—), 5'-alkyletherphosphonates (R=alkylether=methoxymethyl (MeOCH2—), ethoxymethyl, etc., e.g. RP(OH)(O)—O-5'-).

The sense strand can be modified in order to inactivate the sense strand and prevent formation of an active RISC, thereby potentially reducing off-target effects. This can be accomplished by a modification which prevents 5'-phosphorylation of the sense strand, e.g., by modification with a 5'-O-methyl ribonucleotide (see Nykänen et al., (2001) ATP requirements and small interfering RNA structure in the RNA interference pathway. Cell 107, 309-321.) Other modifications which prevent phosphorylation can also be used, e.g., simply substituting the 5'-OH by H rather than O-Me. Alternatively, a large bulky group may be added to the 5'-phosphate turning it into a phosphodiester linkage.

Non-Natural Nucleobases

Nitropyrrolyl and nitroindolyl are non-natural nucleobases that are members of a class of compounds known as universal bases. Universal bases are those compounds that can replace any of the four naturally occurring bases without substantially affecting the melting behavior or activity of the oligonucleotide duplex. In contrast to the stabilizing, hydrogen-bonding interactions associated with naturally occurring nucleobases, it is postulated that oligonucleotide duplexes containing 3-nitropyrrolyl nucleobases are stabilized solely by stacking interactions. The absence of significant hydrogen-bonding interactions with nitropyrrolyl nucleobases obviates the specificity for a specific complementary base. In addition, various reports confirm that 4-, 5- and 6-nitroindolyl display very little specificity for the four natural bases. Interestingly, an oligonucleotide duplex containing 5-nitroindolyl was more stable than the corresponding oligonucleotides containing 4-nitroindolyl and 6-nitroindolyl. Procedures for the preparation of 1-(2'-O-methyl-β-D-ribofuranosyl)-5-nitroindole are described in Gaubert, G.; Wengel, J. *Tetrahedron Letters* 2004, 45, 5629. Other universal bases amenable to the present invention include hypoxanthinyl, isoinosinyl, 2-aza-inosinyl, 7-deaza-inosinyl, nitroimidazolyl, nitropyrazolyl, nitrobenzimidazolyl, nitroindazolyl, aminoindolyl, pyrrolopyrimidinyl, and structural derivatives thereof. For a more detailed discussion, including synthetic procedures, of nitropyrrolyl, nitroindolyl, and other universal bases mentioned above see Vallone et al., Nucleic Acids Research, 27(17):3589-3596 (1999); Loakes et al., J. Mol. Bio., 270: 426-436 (1997); Loakes et al., Nucleic Acids Research, 22(20):4039-4043 (1994); Oliver et al., Organic Letters, Vol. 3(13):1977-1980 (2001); Amosova et al., Nucleic Acids Research, 25(10):1930-1934 (1997); Loakes et al., Nucleic Acids Research, 29(12):2437-2447 (2001); Bergstrom et al., J. Am. Chem. Soc., 117:1201-1209 (1995); Franchetti et al., Biorg. Med. Chem. Lett. 11:67-69 (2001); and Nair et al., Nucelosides, Nucleotides & Nucleic Acids, 20(4-7):735-738 (2001).

Difluorotolyl is a non-natural nucleobase that functions as a universal base. Difluorotolyl is an isostere of the natural nucleobase thymine But unlike thymine, difluorotolyl shows no appreciable selectivity for any of the natural bases. Other aromatic compounds that function as universal bases and are amenable to the present invention are 4-fluoro-6-methylbenzimidazole and 4-methylbenzimidazole. In addition, the relatively hydrophobic isocarbostyrilyl derivatives 3-methyl isocarbostyrilyl, 5-methyl isocarbostyrilyl, and 3-methyl-7-propynyl isocarbostyrilyl are universal bases which cause only slight destabilization of oligonucleotide duplexes compared to the oligonucleotide sequence containing only natural bases. Other non-natural nucleobases contemplated in the present invention include 7-azaindolyl, 6-methyl-7-azaindolyl, imidizopyridinyl, 9-methyl-imidizopyridinyl, pyrrolopyrizinyl, isocarbostyrilyl, 7-propynyl isocarbostyrilyl, propynyl-7-azaindolyl, 2,4,5-trimethylphenyl, 4-methylindolyl, 4,6-dimethylindolyl, phenyl, napthalenyl, anthracenyl, phenanthracenyl, pyrenyl, stilbenzyl, tetracenyl, pentacenyl, and structural derivates thereof. For a more detailed discussion, including synthetic procedures, of difluorotolyl, 4-fluoro-6-methylbenzimidazole, 4-methylbenzimidazole, and other non-natural bases mentioned above, see: Schweitzer et al., J. Org. Chem., 59:7238-7242 (1994); Berger et al., Nucleic Acids Research, 28(15):2911-2914 (2000); Moran et al., J. Am. Chem. Soc., 119:2056-2057 (1997); Morales et al., J. Am. Chem. Soc., 121:2323-2324 (1999); Guckian et al., J. Am. Chem. Soc., 118:8182-8183 (1996); Morales et al., J. Am. Chem. Soc., 122(6):1001-1007 (2000); McMinn et al., J. Am. Chem. Soc., 121:11585-11586 (1999); Guckian et al., J. Org. Chem., 63:9652-9656 (1998); Moran et al., Proc. Natl. Acad. Sci., 94:10506-10511 (1997); Das et al., J. Chem. Soc., Perkin Trans., 1:197-206 (2002); Shibata et al., J. Chem. Soc., Perkin Trans., 1:1605-1611 (2001); Wu et al., J. Am. Chem. Soc., 122(32):7621-7632 (2000); O'Neill et al., J. Org. Chem., 67:5869-5875 (2002); Chaudhuri et al., J. Am. Chem. Soc., 117:10434-10442 (1995); and U.S. Pat. No. 6,218,108.

Further details to the synthesis and use of universal bases is given in co-owned and co-pending PCT/US2005/025967, filed Jul. 21, 2005, hereby incorporated herein by reference in its entirety.

Universal bases can be particularly helpful in situations where one attempts to target a gene in an organism that shows a variability between different strains of that organism. This is often true even for regions of a viral genome that are regarded as highly conserved. The incorporation of a universal base may allow the design of iRNA agents that target a large number of different strains of a virus even though they differ in one, or a few, e.g. in up to three, nucleotide positions.

Universal bases are best included in a region of an iRNA agent that is least sensitive to nucleotide mismatches with regard to specifity and activity of the iRNA agent. It has been shown that position 2-9 of the antisense strand of an iRNA agent are most sensitive to mismatches between the antisense strand an the target mRNA, and this region has been termed the "seed-region" of an iRNA agent. Hence, when incorporating one or several universal base or bases into an iRNA agent, it or they are preferably incorporated outside this seed region.

Table 1F and Table 1G show iRNA agents comprising universal bases in mutually complementary positions in the sense and antisense strand. However, while this is one preferred embodiment of the iRNA agents of the present invention, the effect of the universal base in an iRNA agent is more pronounced when the universal base is present in the antisense strand. It is therefore envisioned that the base in the sense strand in a position where it will pair up with a universal base in the antisense strand may be either a universal base, or any other suitable base, such as a, u, c or g. Preferably, one will test which base in such position of the sense strand will give the highest activity and/or selectivity for the iRNA agent. Alternatively, the base may be chosen that is present in this particular position in a majority of the target gene variants intended to be inhibited in their expression by the iRNA agent in question.

Transport of iRNA Agents into Cells

Not wishing to be bound by any theory, the chemical similarity between cholesterol-conjugated iRNA agents and certain constituents of lipoproteins (e.g. cholesterol, cholesteryl esters, phospholipids) may lead to the association of iRNA agents with lipoproteins (e.g. LDL, HDL) in blood and/or the interaction of the iRNA agent with cellular components having an affinity for cholesterol, e.g. components of the cholesterol transport pathway. Lipoproteins as well as their constituents are taken up and processed by cells by various active and passive transport mechanisms, for example, without limitation, endocytosis of LDL-receptor bound LDL, endocytosis of oxidized or otherwise modified LDLs through interaction with Scavenger receptor A, Scavenger receptor B1-mediated uptake of HDL cholesterol in the liver, pinocytosis, or transport of cholesterol across membranes by ABC (ATP-binding cassette) transporter proteins, e.g. ABC-A1, ABC-G1 or ABC-G4. Hence, cholesterol-conjugated iRNA agents could enjoy facilitated uptake by cells possessing such transport mechanisms, e.g. cells of the liver. As such, the present invention provides evidence and general methods for targeting iRNA agents to cells expressing certain cell surface components, e.g. receptors, by conjugating a natural ligand for such component (e.g. cholesterol) to the iRNA agent, or by conjugating a chemical moiety (e.g. cholesterol) to the iRNA agent which associates with or binds to a natural ligand for the component (e.g. LDL, HDL).

Other Embodiments

An RNA, e.g., an iRNA agent, can be produced in a cell in vivo, e.g., from exogenous DNA templates that are delivered into the cell. For example, the DNA templates can be inserted into vectors and used as gene therapy vectors. Gene therapy vectors can be delivered to a subject by, for example, intravenous injection, local administration (U.S. Pat. No. 5,328,470), or by stereotactic injection (see, e.g., Chen et al. *Proc. Natl. Acad. Sci. USA* 91:3054-3057, 1994). The pharmaceutical preparation of the gene therapy vector can include the gene therapy vector in an acceptable diluent, or can comprise a slow release matrix in which the gene delivery vehicle is imbedded. The DNA templates, for example, can include two transcription units, one that produces a transcript that includes the top strand of an iRNA agent and one that produces a transcript that includes the bottom strand of an iRNA agent. When the templates are transcribed, the iRNA agent is produced, and processed into siRNA agent fragments that mediate gene silencing.

Formulation

The present invention also includes pharmaceutical compositions and formulations which include the dsRNA compounds of the invention. The pharmaceutical compositions of the present invention may be administered in a number of ways depending upon whether local or systemic treatment is desired and upon the area to be treated. Administration may be topical, pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; or intracranial, e.g., intrathecal or intraventricular, administration.

Pharmaceutical compositions and formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful. Preferred topical formulations include those in which the dsRNAs of the invention are in admixture with a topical delivery agent such as lipids, liposomes, fatty acids, fatty acid esters, steroids, chelating agents and surfactants. Preferred lipids and liposomes include neutral (e.g. dioleoylphosphatidyl ethanolamine=DOPE, dimyristoylphosphatidyl choline=DMPC, distearolyphosphatidyl choline) negative (e.g. dimyristoylphosphatidyl glycerol=DMPG) and cationic (e.g. dioleoyltetramethylaminopropyl=DOTAP and dioleoylphosphatidyl ethanolamine=DOTMA). DsRNAs of the invention may be encapsulated within liposomes or may form complexes thereto, in particular to cationic liposomes. Alternatively, dsRNAs may be complexed to lipids, in particular to cationic lipids. Preferred fatty acids and esters include but are not limited arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-10}$ alkyl ester (e.g. isopropylmyristate IPM), monoglyceride, diglyceride or pharmaceutically acceptable salt thereof. Topical formulations are described in detail in U.S. patent application Ser. No. 09/315,298 filed on May 20, 1999 which is incorporated herein by reference in its entirety.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable. Preferred oral formulations are those in which dsRNAs of the invention are administered in conjunction with one or more penetration enhancers, surfactants, and chelators. Preferred surfactants include fatty acids and/or esters or salts thereof, bile acids and/or salts thereof. Preferred bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Preferred fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g. sodium). Also preferred are combinations of penetration enhancers, for example, fatty acids/salts in combination with bile acids/salts. A particularly preferred combination is the sodium salt of lauric acid, capric acid and UDCA. Further penetration enhancers include polyoxyethylene-9-lauryl ether, polyoxyethylene-20-cetyl ether. DsRNAs of the invention may be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Particularly preferred complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g. p-amino), poly (methylcyanoacrylate), poly(ethylcyanoacrylate), poly(butylcyanoacrylate), poly(isobutylcyanoacrylate), poly (isohexylcynaoacrylate), DEAE-methacrylate, DEAE-hexylacrylate, DEAE-acrylamide, DEAE-albumin and DEAE-dextran, polymethylacrylate, polyhexylacrylate, poly (D,L-lactic acid), poly(DL-lactic-co-glycolic acid (PLGA), alginate, and polyethyleneglycol (PEG). Oral formulations for dsRNAs and their preparation are described in detail in U.S. application. Ser. No. 08/886,829 (filed Jul. 1, 1997), Ser. No. 09/108,673 (filed Jul. 1, 1998), Ser. No. 09/256,515 (filed Feb. 23, 1999), Ser. No. 09/082,624 (filed May 21, 1998) and Ser. No. 09/315,298 (filed May 20, 1999), each of which is incorporated herein by reference in their entirety.

Compositions and formulations for parenteral, intrathecal or intraventricular administration may include sterile aqueous solutions which may also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions may be generated from a variety of components that include, but are not limited to, preformed liquids, self-emulsifying solids and self-emulsifying semisolids.

The pharmaceutical formulations of the present invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention may be formulated into any of many possible dosage forms such as, but not limited to, tablets, capsules, gel capsules, liquid syrups, soft gels, suppositories, and enemas. The compositions of the present invention may also be formulated as suspensions in aqueous, non-aqueous or mixed media. Aqueous suspensions may further contain substances which increase the viscosity of the suspension including, for example, sodium carboxymethylcellulose, sorbitol and/or dextran. The suspension may also contain stabilizers.

In one embodiment of the present invention the pharmaceutical compositions may be formulated and used as foams. Pharmaceutical foams include formulations such as, but not limited to, emulsions, microemulsions, creams, jellies and liposomes. While basically similar in nature these formulations vary in the components and the consistency of the final product. The preparation of such compositions and formulations is generally known to those skilled in the pharmaceutical and formulation arts and may be applied to the formulation of the compositions of the present invention.

Emulsions

The compositions of the present invention may be prepared and formulated as emulsions. Emulsions are typically heterogenous systems of one liquid dispersed in another in the form of droplets usually exceeding 0.1 μm in diameter (Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions may be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions may contain additional components in addition to the dispersed phases, and the active drug which may be present as a solution in either the aqueous phase, oily phase or itself as a separate phase. Pharmaceutical excipients such as emulsifiers, stabilizers, dyes, and anti-oxidants may also be present in emulsions as needed. Pharmaceutical emulsions may also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion may be a semisolid or a solid, as is the case of emulsion-style ointment bases and creams. Other means of stabilizing emulsions entail the use of emulsifiers that may be incorporated into either phase of the emulsion. Emulsifiers may broadly be classified into four categories: synthetic surfactants, naturally occurring emulsifiers, absorption bases, and finely dispersed solids (Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants may be classified into different classes based on the nature of the hydrophilic group: nonionic, anionic, cationic and amphoteric (Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that may readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used may be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

In one embodiment of the present invention, the compositions of dsRNAs and nucleic acids are formulated as microemulsions. A microemulsion may be defined as a system of water, oil and amphiphile which is a single optically isotropic and thermodynamically stable liquid solution (Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DA0750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions may, however, be prepared without the use of cosurfactants and alcohol-free self-emulsifying microemulsion systems are known in the art. The aqueous phase may typically be, but is not limited to, water, an aqueous solution of the drug, glycerol, PEG300, PEG400, polyglycerols, propylene glycols, and derivatives of ethylene glycol. The oil phase may include, but is not limited to, materials such as Captex 300, Captex 355, Capmul MCM, fatty acid esters, medium chain ($C_8$-$C_{12}$) mono, di, and tri-glycerides, polyoxyethylated glyceryl fatty acid esters, fatty alcohols, polyglycolized glycerides, saturated polyglycolized $C_8$-$C_{10}$ glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (Constantinides et al., Pharmaceutical Research, 1994, 11, 1385; Ho et al., J. Pharm. Sci., 1996, 85, 138-143). Often microemulsions may form spontaneously when their components are brought together at ambient temperature. This may be particularly advantageous when formulating thermolabile drugs, peptides or dsRNAs. Microemulsions have also been effective in the transdermal delivery of active components in both cosmetic and pharmaceutical applications. It is expected that the microemulsion compositions and formulations of the present invention will facilitate the increased systemic absorption of dsRNAs and nucleic acids from the gastrointestinal tract, as well as improve the local cellular uptake of dsRNAs and nucleic acids within the gastrointestinal tract, vagina, buccal cavity and other areas of administration.

Microemulsions of the present invention may also contain additional components and additives such as sorbitan monostearate (Grill 3), Labrasol, and penetration enhancers to improve the properties of the formulation and to enhance the absorption of the dsRNAs and nucleic acids of the present invention. Penetration enhancers used in the microemulsions of the present invention may be classified as belonging to one of five broad categories surfactants, fatty acids, bile salts, chelating agents, and non-chelating non-surfactants (Lee et al., Critical Reviews in Therapeutic Drug Carrier Systems, 1991, p. 92). Each of these classes has been discussed above.

Liposomes

There are many organized surfactant structures besides microemulsions that have been studied and used for the formulation of drugs. These include monolayers, micelles, bilayers and vesicles. Vesicles, such as liposomes, have attracted great interest because of their specificity and the duration of action they offer from the standpoint of drug delivery. As used in the present invention, the term "liposome" means a vesicle composed of amphiphilic lipids arranged in a spherical bilayer or bilayers.

Liposomes are unilamellar or multilamellar vesicles which have a membrane formed from a lipophilic material and an aqueous interior. The aqueous portion contains the composition to be delivered. Cationic liposomes possess the advantage of being able to fuse to the cell wall. Non-cationic liposomes, although not able to fuse as efficiently with the cell wall, are taken up by macrophages in vivo.

In order to cross intact mammalian skin, lipid vesicles must pass through a series of fine pores, each with a diameter less than 50 nm, under the influence of a suitable transdermal gradient. Therefore, it is desirable to use a liposome which is highly deformable and able to pass through such fine pores.

Further advantages of liposomes include; liposomes obtained from natural phospholipids are biocompatible and biodegradable; liposomes can incorporate a wide range of water and lipid soluble drugs; liposomes can protect encapsulated drugs in their internal compartments from metabolism and degradation (Rosoff, in Pharmaceutical Dosage Forms, Lieberman, Rieger and Banker (Eds.), 1988, Marcel Dekker, Inc., New York, N.Y., volume 1, p. 245). Important considerations in the preparation of liposome formulations are the lipid surface charge, vesicle size and the aqueous volume of the liposomes.

Liposomes are useful for the transfer and delivery of active ingredients to the site of action. Because the liposomal membrane is structurally similar to biological membranes, when liposomes are applied to a tissue, the liposomes start to merge with the cellular membranes and as the merging of the liposome and cell progresses, the liposomal contents are emptied into the cell where the active agent may act.

Liposomal formulations have been the focus of extensive investigation as the mode of delivery for many drugs. There is growing evidence that for topical administration, liposomes present several advantages over other formulations. Such advantages include reduced side-effects related to high systemic absorption of the administered drug, increased accumulation of the administered drug at the desired target, and the ability to administer a wide variety of drugs, both hydrophilic and hydrophobic, into the skin.

Several reports have detailed the ability of liposomes to deliver agents including high-molecular weight DNA into the skin. Compounds including analgesics, antibodies, hormones and high-molecular weight DNAs have been administered to the skin. The majority of applications resulted in the targeting of the upper epidermis Liposomes fall into two broad classes. Cationic liposomes are positively charged liposomes which interact with the negatively charged DNA molecules to form a stable complex. The positively charged DNA/liposome complex binds to the negatively charged cell surface and is internalized in an endosome. Due to the acidic pH within the endosome, the liposomes are ruptured, releasing their contents into the cell cytoplasm (Wang et al., Biochem. Biophys. Res. Commun, 1987, 147, 980-985).

Liposomes which are pH-sensitive or negatively-charged, entrap DNA rather than complex with it. Since both the DNA and the lipid are similarly charged, repulsion rather than complex formation occurs. Nevertheless, some DNA is entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., Journal of Controlled Release, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Several studies have assessed the topical delivery of liposomal drug formulations to the skin. Application of liposomes containing interferon to guinea pig skin resulted in a reduction of skin herpes sores while delivery of interferon via other means (e.g. as a solution or as an emulsion) were ineffective (Weiner et al., Journal of Drug Targeting, 1992, 2, 405-410). Further, an additional study tested the efficacy of interferon administered as part of a liposomal formulation to the administration of interferon using an aqueous system, and concluded that the liposomal formulation was superior to aqueous administration (du Plessis et al., Antiviral Research, 1992, 18, 259-265).

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/ cholesterol/polyoxyethylene-10-stearyl ether) were used to deliver cyclosporin-A into the dermis of mouse skin. Results indicated that such non-ionic liposomal systems were effective in facilitating the deposition of cyclosporin-A into different layers of the skin (Hu et al. S.T.P. Pharma. Sci., 1994, 4, 6, 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_m1$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., FEBS Letters, 1987, 223, 42; Wu et al., Cancer Research, 1993, 53, 3765).

Various liposomes comprising one or more glycolipids are known in the art. Papahadjopoulos et al. (Ann. N.Y. Acad. Sci., 1987, 507, 64) reported the ability of monosialoganglioside $G_m1$, galactocerebroside sulfate and phosphatidylinositol to improve blood half-lives of liposomes. These findings were expounded upon by Gabizon et al. (Proc. Natl. Acad. Sci. U.S.A., 1988, 85, 6949). U.S. Pat. No. 4,837,028 and WO 88/04924, both to Allen et al., disclose liposomes comprising (1) sphingomyelin and (2) the ganglioside $G_m1$ or a galactocerebroside sulfate ester. U.S. Pat. No. 5,543,152 (Webb et al.) discloses liposomes comprising sphingomyelin. Liposomes comprising 1,2-sn-dimyristoylphosphat-idylcholine are disclosed in WO 97/13499 (Lim et al).

Many liposomes comprising lipids derivatized with one or more hydrophilic polymers, and methods of preparation thereof, are known in the art. Sunamoto et al. (Bull. Chem. Soc. Jpn., 1980, 53, 2778) described liposomes comprising a nonionic detergent, $2C_{1215G}$, that contains a PEG moiety. Illum et al. (FEBS Lett., 1984, 167, 79) noted that hydrophilic coating of polystyrene particles with polymeric glycols results in significantly enhanced blood half-lives. Synthetic phospholipids modified by the attachment of carboxylic groups of polyalkylene glycols (e.g., PEG) are described by Sears (U.S. Pat. Nos. 4,426,330 and 4,534,899). Klibanov et al. (FEBS Lett., 1990, 268, 235) described experiments demonstrating that liposomes comprising phosphatidylethanolamine (PE) derivatized with PEG or PEG stearate have significant increases in blood circulation half-lives. Blume et al. (Biochimica et Biophysica Acta, 1990, 1029, 91) extended such observations to other PEG-derivatized phospholipids, e.g., DSPE-PEG, formed from the combination of distearoylphosphatidylethanolamine (DSPE) and PEG. Liposomes having covalently bound PEG moieties on their external surface are described in European Patent No. EP 0 445 131 B1 and WO 90/04384 to Fisher. Liposome compositions containing 1-20 mole percent of PE derivatized with PEG, and methods of use thereof, are described by Woodle et al. (U.S. Pat. Nos. 5,013,556 and 5,356,633) and Martin et al. (U.S. Pat. No. 5,213,804 and European Patent No. EP 0 496 813 B1). Liposomes comprising a number of other lipid-polymer conjugates are disclosed in WO 91/05545 and U.S. Pat. No. 5,225,212 (both to Martin et al.) and in WO 94/20073 (Zalipsky et al.) Liposomes comprising PEG-modified ceramide lipids are described in WO 96/10391 (Choi et al). U.S. Pat. No. 5,540,935 (Miyazaki et al.) and U.S. Pat. No. 5,556,948 (Tagawa et al.) describe PEG-containing liposomes that can be further derivatized with functional moieties on their surfaces.

A limited number of liposomes comprising nucleic acids are known in the art. WO 96/40062 to Thierry et al. discloses methods for encapsulating high molecular weight nucleic acids in liposomes. U.S. Pat. No. 5,264,221 to Tagawa et al. discloses protein-bonded liposomes and asserts that the contents of such liposomes may include dsRNA. U.S. Pat. No. 5,665,710 to Rahman et al. describes certain methods of encapsulating oligodeoxynucleotides in liposomes. WO 97/04787 to Love et al. discloses liposomes comprising dsRNAs targeted to the raf gene.

Transfersomes are yet another type of liposomes, and are highly deformable lipid aggregates which are attractive candidates for drug delivery vehicles. Transfersomes may be described as lipid droplets which are so highly deformable that they are easily able to penetrate through pores which are smaller than the droplet. Transfersomes are adaptable to the environment in which they are used, e.g. they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

Penetration Enhancers

In one embodiment, the present invention employs various penetration enhancers to effect the efficient delivery of nucleic acids, particularly dsRNAs, to the skin of animals. Most drugs are present in solution in both ionized and non-ionized forms. However, usually only lipid soluble or lipophilic drugs readily cross cell membranes. It has been discovered that even non-lipophilic drugs may cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers may be classified as belonging to one of five broad categories, i.e., surfactants, fatty acids, bile salts, chelating agents, and non-chelating non-surfactants (Lee et al., Critical Reviews in Therapeutic Drug Carrier Systems, 1991, p. 92). Each of the above mentioned classes of penetration enhancers are described below in greater detail.

Surfactants: In connection with the present invention, surfactants (or "surface-active agents") are chemical entities which, when dissolved in an aqueous solution, reduce the surface tension of the solution or the interfacial tension between the aqueous solution and another liquid, with the result that absorption of dsRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (Lee et al., Critical Reviews in Therapeutic Drug Carrier Systems, 1991, p. 92); and perfluorochemical emulsions, such as FC-43 (Takahashi et al., J. Pharm. Pharmacol., 1988, 40, 252).

Fatty acids: Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_1$-$C_{10}$ alkyl esters thereof (e.g., methyl, isopropyl and t-butyl), and mono- and di-glycerides thereof (i.e., oleate, laurate, caprate, myristate, palmitate, stearate, linoleate, etc.) (Lee et al., Critical Reviews in Therapeutic Drug Carryier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

Bile salts: The physiological role of bile includes the facilitation of dispersion and absorption of lipids and fat-soluble vitamins (Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. The bile salts of the invention include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating Agents: Chelating agents, as used in connection with the present invention, can be defined as compounds that remove metallic ions from solution by forming complexes therewith, with the result that absorption of dsRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Chelating agents of the invention include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

Non-chelating non-surfactants: As used herein, non-chelating non-surfactant penetration enhancing compounds can be defined as compounds that demonstrate insignificant activity as chelating agents or as surfactants but that nonetheless enhance absorption of dsRNAs through the alimentary mucosa (Muranishi, Critical Reviews in Therapeutic Drug Carrier Systems, 1990, 7, 1-33). This class of penetration enhancers include, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of dsRNAs at the cellular level may also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs.

Other agents may be utilized to enhance the penetration of the administered nucleic acids, including glycols such as ethylene glycol and propylene glycol, pyrrols such as 2-pyrrol, azones, and terpenes such as limonene and menthone.

Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4' isothiocyano-stilbene-2,2'-disulfonic acid (Miyao et al., Antisense Res. Dev., 1995, 5, 115-121; Takakura et al., Antisense & Nucl. Acid Drug Dev., 1996, 6, 177-183.

Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient may be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipient suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids may include sterile and non-sterile aqueous solutions, non-aqueous solutions in common solvents such as alcohols, or solutions of the nucleic acids in liquid or solid oil bases. The solutions may also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

Pharmaceutical Compositions for the Delivery to the Respiratory Tract

Another aspect of the invention provides for the delivery of IRNA agents to the respiratory tract, particularly for the treatment of cystic fibrosis. The respiratory tract includes the upper airways, including the oropharynx and larynx, followed by the lower airways, which include the trachea followed by bifurcations into the bronchi and bronchioli. The upper and lower airways are called the conductive airways. The terminal bronchioli then divide into respiratory bronchioli which then lead to the ultimate respiratory zone, the alveoli, or deep lung. The deep lung, or alveoli, are the primary target of inhaled therapeutic aerosols for systemic delivery of iRNA agents.

Pulmonary delivery compositions can be delivered by inhalation by the patient of a dispersion so that the composition, preferably the iRNA agent, within the dispersion can reach the lung where it can, for example, be readily absorbed through the alveolar region directly into blood circulation. Pulmonary delivery can be effective both for systemic delivery and for localized delivery to treat diseases of the lungs.

Pulmonary delivery can be achieved by different approaches, including the use of nebulized, aerosolized, micellular and dry powder-based formulations; administration by inhalation may be oral and/or nasal. Delivery can be achieved with liquid nebulizers, aerosol-based inhalers, and dry powder dispersion devices. Metered-dose devices are preferred. One of the benefits of using an atomizer or inhaler is that the potential for contamination is minimized because the devices are self contained. Dry powder dispersion devices, for example, deliver drugs that may be readily formulated as dry powders. An iRNA composition may be stably stored as lyophilized or spray-dried powders by itself or in combination with suitable powder carriers. The delivery of a composition for inhalation can be mediated by a dosing timing element which can include a timer, a dose counter, time measuring device, or a time indicator which when incorporated into the device enables dose tracking, compliance monitoring, and/or dose triggering to a patient during administration of the aerosol medicament.

Examples of pharmaceutical devices for aerosol delivery include metered dose inhalers (MDIs), dry powder inhalers (DPIs), and air-jet nebulizers. Exemplary delivery systems by inhalation which can be readily adapted for delivery of the subject iRNA agents are described in, for example, U.S. Pat. Nos. 5,756,353; 5,858,784; and PCT applications WO98/31346; WO98/10796; WO00/27359; WO01/54664; WO02/060412. Other aerosol formulations that may be used for delivering the iRNA agents are described in U.S. Pat. Nos. 6,294,153; 6,344,194; 6,071,497, and PCT applications WO02/066078; WO02/053190; WO01/60420; WO00/66206. Further, methods for delivering iRNA agents can be adapted from those used in delivering other oligonucleotides (e.g., an antisense oligonucleotide) by inhalation, such as described in Templin et al., Antisense Nucleic Acid Drug Dev, 2000, 10:359-68; Sandrasagra et al., Expert Opin Biol Ther, 2001, 1:979-83; Sandrasagra et al., Antisense Nucleic Acid Drug Dev, 2002, 12:177-81.

The delivery of the inventive agents may also involve the administration of so called "pro-drugs", i.e. formulations or chemical modifications of a therapeutic substance that require some form of processing or transport by systems innate to the subject organism to release the therapeutic substance, preferably at the site where its action is desired; this latter embodiment may be used in conjunction with delivery of the respiratory tract, but also together with other embodiments of the present invention. For example, the human lungs can remove or rapidly degrade hydrolytically cleavable deposited aerosols over periods ranging from minutes to hours. In the upper airways, ciliated epithelia contribute to the "mucociliary excalator" by which particles are swept from the airways toward the mouth. Pavia, D., "Lung Mucociliary Clearance," in Aerosols and the Lung: Clinical and Experimental Aspects, Clarke, S. W. and Pavia, D., Eds., Butterworths, London, 1984. In the deep lungs, alveolar macrophages are capable of phagocytosing particles soon after their deposition. Warheit et al. Microscopy Res. Tech., 26: 412-422

(1993); and Brain, J. D., "Physiology and Pathophysiology of Pulmonary Macrophages," in The Reticuloendothelial System, S. M. Reichard and J. Filkins, Eds., Plenum, New. York., pp. 315-327, 1985.

In preferred embodiments, particularly where systemic dosing with the iRNA agent is desired, the aerosoled iRNA agents are formulated as microparticles. Microparticles having a diameter of between 0.5 and ten microns can penetrate the lungs, passing through most of the natural barriers. A diameter of less than ten microns is required to bypass the throat; a diameter of 0.5 microns or greater is required to avoid being exhaled.

Other Components

The compositions of the present invention may additionally contain other adjunct components conventionally found in pharmaceutical compositions, at their art-established usage levels. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions may contain substances which increase the viscosity of the suspension including, for example, sodium carboxymethylcellulose, sorbitol and/or dextran. The suspension may also contain stabilizers.

Certain embodiments of the invention provide pharmaceutical compositions containing (a) one or more dsRNA agents and (b) one or more other chemotherapeutic agents which function by a non-RNA interference mechanism. Examples of such chemotherapeutic agents include but are not limited to daunorubicin, daunomycin, dactinomycin, doxorubicin, epirubicin, idarubicin, esorubicin, bleomycin, mafosfamide, ifosfamide, cytosine arabinoside, bis-chloroethylnitrosurea, busulfan, mitomycin C, actinomycin D, mithramycin, prednisone, hydroxyprogesterone, testosterone, tamoxifen, dacarbazine, procarbazine, hexamethylmelamine, pentamethylmelamine, mitoxantrone, amsacrine, chlorambucil, methylcyclohexylnitrosurea, nitrogen mustards, melphalan, cyclophosphamide, 6-mercaptopurine, 6-thioguanine, cytarabine, 5-azacytidine, hydroxyurea, deoxycoformycin, 4-hydroxyperoxycyclophosphoramide, 5-fluorouracil (5-FU), 5-fluorodeoxyuridine (5-FUdR), methotrexate (MTX), colchicine, taxol, vincristine, vinblastine, etoposide (VP-16), trimeterxate, irinotecan, topotecan, gemcitabine, teniposide, cisplatin and diethylstilbestrol (DES). See, generally, The Merck Manual of Diagnosis and Therapy, 15th Ed. 1987, pp. 1206-1228, Berkow et al., eds., Rahway, N.J. When used with the compounds of the invention, such chemotherapeutic agents may be used individually (e.g., 5-FU and oligonucleotide), sequentially (e.g., 5-FU and oligonucleotide for a period of time followed by MTX and oligonucleotide), or in combination with one or more other such chemotherapeutic agents (e.g., 5-FU, MTX and oligonucleotide, or 5-FU, radiotherapy and oligonucleotide). Anti-inflammatory drugs, including but not limited to nonsteroidal anti-inflammatory drugs and corticosteroids, and antiviral drugs, including but not limited to ribivirin, vidarabine, acyclovir and ganciclovir, may also be combined in compositions of the invention. See, generally, The Merck Manual of Diagnosis and Therapy, 15th Ed., Berkow et al., eds., 1987, Rahway, N.J., pages 2499-2506 and 46-49, respectively). Other non-dsRNA chemotherapeutic agents are also within the scope of this invention. Two or more combined compounds may be used together or sequentially.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds which exhibit high therapeutic indices are preferred.

The data obtained from cell culture assays and animal studies can be used in formulation a range of dosage for use in humans. The dosage of compositions of the invention lies generally within a range of circulating concentrations that include the ED50 with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

In addition to their administration individually or as a plurality, as discussed above, the dsRNAs of the invention can be administered in combination with other known agents effective in treatment of influenza infection. In any event, the administering physician can adjust the amount and timing of dsRNA administration on the basis of results observed using standard measures of efficacy known in the art or described herein.

Treatment Methods and Routes of Delivery

A composition that includes an iRNA agent, e.g., an iRNA agent that targets influenza virus, can be delivered to a subject by a variety of routes to achieve either local delivery to the site of action of systemic delivery to the subject. Exemplary routes include direct local administration to the site of treatment, such as the lungs and nasal passage as well as intravenous, nasal, oral, and ocular delivery. The preferred means of administering the iRNA agents of the present invention is through direct admisitration to the lungs and nasal passage as a liquid, aerosol or nubulized solution.

In general, the delivery of the iRNA agents of the present invention is done to achieve delivery into the subject to the site of infection. The preferred means of achieving this is through either a local administration to the lungs or nasal passage, e.g. into the respiratory tissues via inhalation or intranasal administration, or via systemic administration, e.g. parental administration.

Formulations for inhalation or parenteral administration are well known in the art. Such formulation may include sterile aqueous solutions which may also contain buffers, diluents and other suitable additives. For intravenous use, the total concentration of solutes should be controlled to render the preparation isotonic.

The active compounds disclosed herein are preferably administered to the lung(s) or nasal passage of a subject by any suitable means. Active compounds may be administered by administering an aerosol suspension of respirable particles comprised of the active compound or active compounds, which the subject inhales. The active compound can be aerosolized in a variety of forms, such as, but not limited to, dry powder inhalants, metered dose inhalants, or liquid/liquid suspensions. The respirable particles may be liquid or solid. The particles may optionally contain other therapeutic ingredients such as amiloride, benzamil or phenamil, with the selected compound included in an amount effective to inhibit the reabsorption of water from airway mucous secretions, as described in U.S. Pat. No. 4,501,729.

The particulate pharmaceutical composition may optionally be combined with a carrier to aid in dispersion or transport. A suitable carrier such as a sugar (i.e., lactose, sucrose, trehalose, mannitol) may be blended with the active compound or compounds in any suitable ratio (e.g., a 1 to 1 ratio by weight).

Particles comprised of the active compound for practicing the present invention should include particles of respirable size, that is, particles of a size sufficiently small to pass through the mouth or nose and larynx upon inhalation and into the bronchi and alveoli of the lungs. In general, particles ranging from about 1 to 10 microns in size (more particularly, less than about 5 microns in size) are respirable. Particles of non-respirable size which are included in the aerosol tend to deposit in the throat and be swallowed, and the quantity of non-respirable particles in the aerosol is preferably minimized. For nasal administration, a particle size in the range of 10-500 uM is preferred to ensure retention in the nasal cavity.

Liquid pharmaceutical compositions of active compound for producing an aerosol may be prepared by combining the active compound with a suitable vehicle, such as sterile pyrogen free water. The hypertonic saline solutions used to carry out the present invention are preferably sterile, pyrogen-free solutions, comprising from one to fifteen percent (by weight) of the physiologically acceptable salt, and more preferably from three to seven percent by weight of the physiologically acceptable salt.

Aerosols of liquid particles comprising the active compound may be produced by any suitable means, such as with a pressure-driven jet nebulizer or an ultrasonic nebulizer. See, e.g., U.S. Pat. No. 4,501,729. Nebulizers are commercially available devices which transform solutions or suspensions of the active ingredient into a therapeutic aerosol mist either by means of acceleration of compressed gas, typically air or oxygen, through a narrow venturi orifice or by means of ultrasonic agitation.

Suitable formulations for use in nebulizers consist of the active ingredient in a liquid carrier, the active ingredient comprising up to 40% w/w of the formulation, but preferably less than 20% w/w. The carrier is typically water (and most preferably sterile, pyrogen-free water) or a dilute aqueous alcoholic solution, preferably made isotonic, but may be hypertonic with body fluids by the addition of, for example, sodium chloride. Optional additives include preservatives if the formulation is not made sterile, for example, methyl hydroxybenzoate, antioxidants, flavoring agents, volatile oils, buffering agents and surfactants.

Aerosols of solid particles comprising the active compound may likewise be produced with any solid particulate therapeutic aerosol generator. Aerosol generators for administering solid particulate therapeutics to a subject produce particles which are respirable and generate a volume of aerosol containing a predetermined metered dose of a therapeutic at a rate suitable for human administration. One illustrative type of solid particulate aerosol generator is an insufflator. Suitable formulations for administration by insufflation include finely comminuted powders which may be delivered by means of an insufflator or taken into the nasal cavity in the manner of a snuff. In the insufflator, the powder (e.g., a metered dose thereof effective to carry out the treatments described herein) is contained in capsules or cartridges, typically made of gelatin or plastic, which are either pierced or opened in situ and the powder delivered by air drawn through the device upon inhalation or by means of a manually-operated pump. The powder employed in the insufflator consists either solely of the active ingredient or of a powder blend comprising the active ingredient, a suitable powder diluent, such as lactose, and an optional surfactant. The active ingredient typically comprises from 0.1 to 100 w/w of the formulation.

A second type of illustrative aerosol generator comprises a metered dose inhaler. Metered dose inhalers are pressurized aerosol dispensers, typically containing a suspension or solution formulation of the active ingredient in a liquefied propellant. During use these devices discharge the formulation through a valve adapted to deliver a metered volume, typically from 10 to 200 ul, to produce a fine particle spray containing the active ingredient. Suitable propellants include certain chlorofluorocarbon compounds, for example, dichlorodifluoromethane, trichlorofluoromethane, dichlorotetrafluoroethane and mixtures thereof. The formulation may additionally contain one or more co-solvents, for example, ethanol, surfactants, such as oleic acid or sorbitan trioleate, antioxidant and suitable flavoring agents.

An iRNA agent can be incorporated into pharmaceutical compositions suitable for administration. For example, compositions can include one or more species of an iRNA agent and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

Administration can be provided by the subject or by another person, e.g., a caregiver. A caregiver can be any entity involved with providing care to the human: for example, a hospital, hospice, doctor's office, outpatient clinic; a healthcare worker such as a doctor, nurse, or other practitioner; or a spouse or guardian, such as a parent. The medication can be provided in measured doses or in a dispenser which delivers a metered dose.

The term "therapeutically effective amount" is the amount present in the composition that is needed to provide the desired level of drug in the subject to be treated to give the anticipated physiological response.

The term "physiologically effective amount" is that amount delivered to a subject to give the desired palliative or curative effect.

The term "pharmaceutically acceptable carrier" means that the carrier can be taken into the lungs with no significant adverse toxicological effects on the lungs.

The term "co-administration" refers to administering to a subject two or more agents, and in particular two or more iRNA agents. The agents can be contained in a single pharmaceutical composition and be administered at the same time, or the agents can be contained in separate formulation and administered serially to a subject. So long as the two agents can be detected in the subject at the same time, the two agents are said to be co-administered.

The types of pharmaceutical excipients that are useful as carrier include stabilizers such as human serum albumin (HSA), bulking agents such as carbohydrates, amino acids and polypeptides; pH adjusters or buffers; salts such as sodium chloride; and the like. These carriers may be in a crystalline or amorphous form or may be a mixture of the two.

Bulking agents that are particularly valuable include compatible carbohydrates, polypeptides, amino acids or combinations thereof. Suitable carbohydrates include monosaccharides such as galactose, D-mannose, sorbose, and the like; disaccharides, such as lactose, trehalose, and the like; cyclodextrins, such as 2-hydroxypropyl-.beta.-cyclodextrin; and polysaccharides, such as raffinose, maltodextrins, dextrans, and the like; alditols, such as mannitol, xylitol, and the like. A preferred group of carbohydrates includes lactose, threhalose, raffinose maltodextrins, and mannitol. Suitable polypeptides include aspartame. Amino acids include alanine and glycine, with glycine being preferred.

Suitable pH adjusters or buffers include organic salts prepared from organic acids and bases, such as sodium citrate, sodium ascorbate, and the like; sodium citrate is preferred.

Dosage

An iRNA agent can be administered at a unit dose less than about 75 mg per kg of bodyweight, or less than about 70, 60, 50, 40, 30, 20, 10, 5, 2, 1, 0.5, 0.1, 0.05, 0.01, 0.005, 0.001, or 0.0005 mg per kg of bodyweight, and less than 200 nmol of iRNA agent (e.g., about 4.4×1016 copies) per kg of bodyweight, or less than 1500, 750, 300, 150, 75, 15, 7.5, 1.5, 0.75, 0.15, 0.075, 0.015, 0.0075, 0.0015, 0.00075, 0.00015 nmol of iRNA agent per kg of bodyweight. The unit dose, for example, can be administered by injection (e.g., intravenous or intramuscular, intrathecally, or directly into an organ), an inhaled dose, or a topical application.

Delivery of an iRNA agent directly to an organ (e.g., to the lung) can be at a dosage on the order of about 0.00001 mg to about 3 mg per organ, or preferably about 0.0001-0.001 mg per organ, about 0.03-3.0 mg per organ, about 0.1-3.0 mg per eye or about 0.3-3.0 mg per organ.

The dosage can be an amount effective to treat or prevent a disease or disorder. It can be given prophylactically or as the primary or a part of a treatment protocol.

In one embodiment, the unit dose is administered less frequently than once a day, e.g., less than every 2, 4, 8 or 30 days. In another embodiment, the unit dose is not administered with a frequency (e.g., not a regular frequency). For example, the unit dose may be administered a single time. Because iRNA agent mediated silencing can persist for several days after administering the iRNA agent composition, in many instances, it is possible to administer the composition with a frequency of less than once per day, or, for some instances, only once for the entire therapeutic regimen.

In one embodiment, a subject is administered an initial dose, and one or more maintenance doses of an iRNA agent, e.g., a double-stranded iRNA agent, or siRNA agent, (e.g., a precursor, e.g., a larger iRNA agent which can be processed into an siRNA agent, or a DNA which encodes an iRNA agent, e.g., a double-stranded iRNA agent, or siRNA agent, or precursor thereof). The maintenance dose or doses are generally lower than the initial dose, e.g., one-half less of the initial dose. A maintenance regimen can include treating the subject with a dose or doses ranging from 0.01 to 75 mg/kg of body weight per day, e.g., 70, 60, 50, 40, 30, 20, 10, 5, 2, 1, 0.5, 0.1, 0.05, 0.01, 0.005, 0.001, or 0.0005 mg per kg of body weight per day. The maintenance doses are preferably administered no more than once every 5, 10, or 30 days. Further, the treatment regimen may last for a period of time which will vary depending upon the nature of the particular disease, its severity and the overall condition of the patient. In preferred embodiments the dosage may be delivered no more than once per day, e.g., no more than once per 24, 36, 48, or more hours, e.g., no more than once every 5 or 8 days. Following treatment, the patient can be monitored for changes in his condition and for alleviation of the symptoms of the disease state. The dosage of the compound may either be increased in the event the patient does not respond significantly to current dosage levels, or the dose may be decreased if an alleviation of the symptoms of the disease state is observed, if the disease state has been ablated, or if undesired side-effects are observed.

The effective dose can be administered in a single dose or in two or more doses, as desired or considered appropriate under the specific circumstances. If desired to facilitate repeated or frequent infusions, implantation of a delivery device, e.g., a pump, semi-permanent stent (e.g., intravenous, intraperitoneal, intracisternal or intracapsular), or reservoir may be advisable.

Following successful treatment, it may be desirable to have the patient undergo maintenance therapy to prevent the recurrence of the disease state, wherein the compound of the invention is administered in maintenance doses, ranging from 0.001 g to 100 g per kg of body weight (see U.S. Pat. No. 6,107,094).

The concentration of the iRNA agent composition is an amount sufficient to be effective in treating or preventing a disorder or to regulate a physiological condition in humans. The concentration or amount of iRNA agent administered will depend on the parameters determined for the agent and the method of administration, e.g. nasal, buccal, or pulmonary. For example, nasal formulations tend to require much lower concentrations of some ingredients in order to avoid irritation or burning of the nasal passages. It is sometimes desirable to dilute an oral formulation up to 10-100 times in order to provide a suitable nasal formulation.

Certain factors may influence the dosage required to effectively treat a subject, including but not limited to the severity of the disease or disorder, previous treatments, the general health and/or age of the subject, and other diseases present. It will also be appreciated that the effective dosage of an iRNA agent such as an siRNA used for treatment may increase or decrease over the course of a particular treatment. Changes in dosage may result and become apparent from the results of diagnostic assays. For example, the subject can be monitored after administering an iRNA agent composition. Based on information from the monitoring, an additional amount of the iRNA agent composition can be administered.

Dosing is dependent on severity and responsiveness of the disease condition to be treated, with the course of treatment lasting from several days to several months, or until a cure is effected or a diminution of disease state is achieved. Optimal dosing schedules can be calculated from measurements of drug accumulation in the body of the patient. Persons of ordinary skill can easily determine optimum dosages, dosing methodologies and repetition rates. Optimum dosages may vary depending on the relative potency of individual compounds, and can generally be estimated based on EC50s found to be effective in in vitro and in vivo animal models as described above.

The invention is further illustrated by the following examples, which should not be construed as further limiting.

EXAMPLES

Nucleic acid sequences are represented below using standard nomenclature, and specifically the abbreviations of Table 3.

TABLE 3

Abbreviations of nucleotide monomers used in nucleic acid sequence representation. It will be understood that these monomers, when present in an oligonucleotide, are mutually linked by 5'-3'-phosphodiester bonds.

| Abbreviation[a] | Nucleotide(s) |
|---|---|
| A, a | 2'-deoxy-adenosine-5'-phosphate, adenosine-5'-phosphate |
| C, c | 2'-deoxy-cytidine-5'-phosphate, cytidine-5'-phosphate |
| G, g | 2'-deoxy-guanosine-5'-phosphate, guanosine-5'-phosphate |
| T, t | 2'-deoxy-thymidine-5'-phosphate, thymidine-5'-phosphate |
| U, u | 2'-deoxy-uridine-5'-phosphate, uridine-5'-phosphate |
| N, n | any 2'-deoxy-nucleotide/nucleotide (G, A, C, or T, g, a, c or u) |
| am | 2'-O-methyladenosine-5'-phosphate |
| cm | 2'-O-methylcytidine-5'-phosphate |
| gm | 2'-O-methylguanosine-5'-phosphate |
| tm | 2'-O-methyl-thymidine-5'-phosphate |
| um | 2'-O-methyluridine-5'-phosphate |
| A, C, G, T, U, a, c, g, t, u | underlined: nucleoside-5'-phosphorothioate |
| x | universal base |

[a]capital letters represent 2'-deoxyribonucleotides (DNA), lower case letters represent ribonucleotides (RNA)

Source of Reagents

Where the source of a reagent is not specifically given herein, such reagent may be obtained from any supplier of reagents for molecular biology at a quality/purity standard for application in molecular biology.

Example 1

Selection of Sequences siRNA design was carried out to identify siRNAs targeting Influenza A mRNAs of MP, NP, PA, PB1 and PB2 protein. In a first round, the siRNA in silico selection resulted in 44 sequences targeting MP, 3 sequences targeting NP and 1 sequence targeting PB1. No siRNAs specific for influenza A genes PA or PB2 passed the first selection process demanding 80% target coverage and 80% target efficiency (see below).

To setup an environment for sequence analysis, the fastA package (Pearson, W. R., & Lipman, D. J., PNAS 1988, 85:2444) was downloaded from ftp://ftp.virginia.edu/pub/ and installed on a workstation under the Suse Linux® 9.3 operating system with standard installation settings. For the purpose of running perl scripts, it was ensured that the perl interpreter, version 5.8.6 (copyright 1987-2004, Larry Wall), coming with the Suse Linux 9.3 standard installation was functional. BioEdit Sequence Alignment Editor (Hall, T. A., Nucl. Acids. Symp. Ser. 1999, 41:95) was downloaded from the Brown Lab Web Server at the web site of North Carolina State University and installed on a computer under Microsoft Windows2000® operating system.

Workflow for the in silico selection was as follows: influenza A sequences of interest were downloaded, aligned and a statistics was generated to obtain distribution of bases at every position relative to a calculated consensus. A perl script was used to identify candidate target regions satisfying defined cut-off criteria. siRNA sequences to candidate target regions were analyzed for specificity by fastA algorithm to human RefSeq database. Another perl script was used to score siRNAs according to predicted specificity. Finally, those siRNAs were manually selected that satisfied specificity criteria.

Influenza A sequences of interest available on Jun. 24, 2005 were downloaded from NCBI Influenza Virus Database available on the web site of the National Center for Biotechnology Information. The number of sequences per gene is shown for MP, NP, PB1, PB2, and PA in Table 4, the corresponding accession numbers are given in Table 4.

TABLE 4

Number of gene sequences for influenza genes MP, NP PB1, PB2, and PA from various viral subtypes that were employed in in silico selection of siRNA sequences

| Gene | H1N1 | H2N2 | H3N2 | H5N1 | H7N3 | H7N7 | H9N2 | Total |
|---|---|---|---|---|---|---|---|---|
| MP | 10 | 2 | 13 | 166 | 28 | 16 | 128 | 363 |
| NP | 12 | 3 | 10 | 169 | 12 | 6 | 138 | 350 |
| PB1 | 3 | 2 | 10 | 163 | 10 | 7 | 127 | 322 |
| PB2 | 2 | 1 | 10 | 164 | 12 | 9 | 133 | 331 |
| PA | 2 | 2 | 10 | 171 | 11 | 8 | 124 | 328 |

The ClustalW multiple alignment function (Thompson, J. D., et al., Nucleic Acids Res. 1994; 22:4673) of BioEdit Sequence Alignment Editor was used to generate a global alignment of all sequences using default parameters for each target, respectively. A Positional nucleotide numerical summary output was generated providing information on base distribution at every position relative to the calculated consensus sequence for each target.

Cut-off criteria for the identification of candidate targeting regions of 19 nucleotides in length were defined as:

Criterium 1, target coverage: at least 80% of all sequences available for the respective influenza A gene needed to be represented in a candidate region Criterium 2, targeting efficency: at least 80% of all sequences in which the candidate region was represented needed to be identical within the candidate region.

Criterium 1 was defined in order to avoid regions for which little sequence information was available, criterium 2 ensures targeting of a high number of subtypes.

A perl script was used for screening the Positional nucleotide numerical summary file to identify candidate target regions with a length of 19 bases matching the cut-off criteria and to generate a file to be used as fastA input in the following analysis step. For script input the total number of sequences were entered for each target and a value of 80 for percentage conservation. All candidate sense siRNA sequences corresponding to the most frequent sequences in the candidate target regions were extracted and saved in a fastA-formatted file. In order to consider potential dTdT-overhang interactions of siRNAs with the target sequence, all sequences were extended at the 5' end with 'AA' resulting in 21mer input sequences. A further file was generated for each candidate target region with information on region properties: target coverage (sequences present) targeting efficiency, total number of mismatches, number of conserved sequences, and number of sequences present.

For further selection, candidate siRNAs were ranked according to their predicted potential for interacting with host (here, without limitation, human) genes (off-target potential). siRNAs with low off-target potential are assumed to be more specific in vivo.

For predicting siRNA-specific off-target potential, the following assumptions were made:

1) positions 2 to 9 (counting 5' to 3') of a strand (seed region) contributes more to the off-target potential than the remaining sequence (non-seed region) (Haley, B., and Zamore, P. D., Nat Struct Mol Biol. 2004, 11:599).

2) an off-target score can be calculated for each hit, based on identity to siRNA sequence and position of mismatches 3) by introducing appropriate nucleotide modifications into the sense strand (e.g. all nucleotides comprising a pyrimidine base are 2'-O-methyl modified nucleotides), the sense strand can be made inactive towards RNA interference; hence, only the off-target potential of the antisense strand need be considered To identify potential off-target genes, the 21mer sequences corresponding to the candidate target regions plus a 3'-terminal AA tail (to account for the TT overhangs) were subjected to a homology search against publically available human mRNA sequences. To this purpose, fastA (version 3.4) searches were performed with all 21mer input sequences against a human RefSeq database (downloaded available version from ftp://ftp.ncbi.nih.gov/refseq/on 2005-07-25). fastA search was executed with parameters-values-pairs −b 30−g 30 in order to take into account the homology over the full length of the 21mer. The search resulted in a list of potential off-targets for candidate siRNAs.

To sort the resulting list of potential off-targets, fastA output files were analyzed to identify the host gene with the highest off-target score. The following off-target properties for each 21mer input sequence were extracted for each potential off-target to calculate the off-target score:

1. Number of identical nucleotides to 21mer sequence (Identity)

2. Number of mismatches in seed region

The off-target score was calculated for considering assumption 1 and 2 as follows:

Identity−0.2*number of seed mismatches

All siRNAs were sorted according to their highest off-target score (ascending). An off-target score of 16.8 was used as a cut-off for siRNA selection. 42 siRNAs specific for influenza A matrix protein (MP), 3 siRNAs specific for influenza A nucleocapsid protein (NP), and 1 siRNA specific for influenza A Polymerase Basic protein 1 (PB1) had off target scores at or below this threshold.

Given the comparatively low number of candidate siRNAs resulting from the above selection procedure, the Positional nucleotide numerical summary was re-examined with cut-off for criterium 1 (target coverage) set to 70% and criterium 2 (target specificity) remaining at 80%, followed by a repeat off-target score ranking as described above. 2 additional siRNAs specific for influenza A MP mRNA with a targeting efficiency of 79.9% were additionally selected, for a total of 48 candidate siRNAs. The sequences of these 48 candidate siRNAs are shown in Table 1A.

Because the selection process described above resulted only in a limited number of candidate agents, the selection criteria were somewhat relaxed to yield further candidate agents. Specifically, criterium 1, above, was relaxed to 50% target coverage, criterium 2, target efficiency, was kept at 80%, and the above selection process was repeated. This procedure yielded the additional agents AL-DP-8001 to AL-DP-8040, listed in Table 1C.

In this process, it was realized that the off-target scoring step led to the greatest attrition rate in potential agents. In order to obtain yet more candidate agents, the selection process was therefore repeated once more, using criterium 1 at 80% target coverage, criterium 2 at 80% target efficiency, and the off-target scoring was omitted. This procedure yielded the additional agents listed in Table 1D. Yet further candidate agents, listed in Table 1E, were obtained by repeating the selection once again, using criterium 1 at 50% target coverage, criterium 2 at 80% target efficiency, and omitting off-target scoring.

Additional candidate iRNA agents were identified by allowing for the incorporation of universal bases. A Perl script was used to first identify candidate sequences having target coverage and target efficiency of 100% when the incorporation of up to 3 universal bases in the non-seed region (corresponding to positions 2-9 of the antisense strand) of the iRNA agent per strand. Table 1F shows the agents identified in this manner. In a second round, additional iRNA agents were identified that possess target coverage and target efficiency of 80% when allowing for the incorporation of one universal base. These iRNA agents are shown in Table 1G.

Example 2 siRNA Synthesis

Synthesis of Nucleotides Comprising Natural Bases

Single-stranded RNAs were produced by solid phase synthesis on a scale of 1 mmole using an Expedite 8909 synthesizer (Applied Biosystems, Applera Deutschland GmbH, Darmstadt, Germany) and controlled pore glass (CPG, 500Å, Glen Research, Sterling Va.) as solid support. RNA and RNA containing 2'-O-methyl nucleotides were generated by solid phase synthesis employing the corresponding phosphoramidites and 2'-O-methyl phosphoramidites, respectively (Proligo Biochemie GmbH, Hamburg, Germany). These building blocks were incorporated at selected sites within the sequence of the oligoribonucleotide chain using standard nucleoside phosphoramidite chemistry such as described in Current protocols in nucleic acid chemistry, Beaucage, S. L. et al. (Edrs.), John Wiley & Sons, Inc., New York, N.Y., USA. Phosphorothioate linkages were introduced by replacement of the iodine oxidizer solution with a solution of the Beaucage reagent (Chruachem Ltd, Glasgow, UK) in acetonitrile (1%). Further ancillary reagents were obtained from Mallinckrodt Baker (Griesheim, Germany).

Deprotection and purification by anion exchange HPLC of the crude oligoribonucleotides were carried out according to established procedures. Yields and concentrations were determined by UV absorption of a solution of the respective RNA at a wavelength of 260 nm using a spectral photometer (DU 640B, Beckman Coulter GmbH, UnterschleiBheim, Germany). Double stranded RNA was generated by mixing an equimolar solution of complementary strands in annealing buffer (20 mM sodium phosphate, pH 6.8; 100 mM sodium chloride), heated in a water bath at 85-90° C. for 3 minutes and cooled to room temperature over a period of 3-4 hours. The purified RNA solution was stored at −20° C. until use.

As a result of the synthesis strategy described above, all oligonucleotides synthesized as described above do not comprise a phosphate group on their 5'-most nucleotide.

Synthesis of Nucleotides Comprising Universal Bases

Synthesis of Phosphoramidite and controlled pore glass support of 5'-O-(4,4'-dimethoxitrityl)-2'-O-(tert-butyldimethylsilyl)-1'-(5-nitroindole)-D-riboside

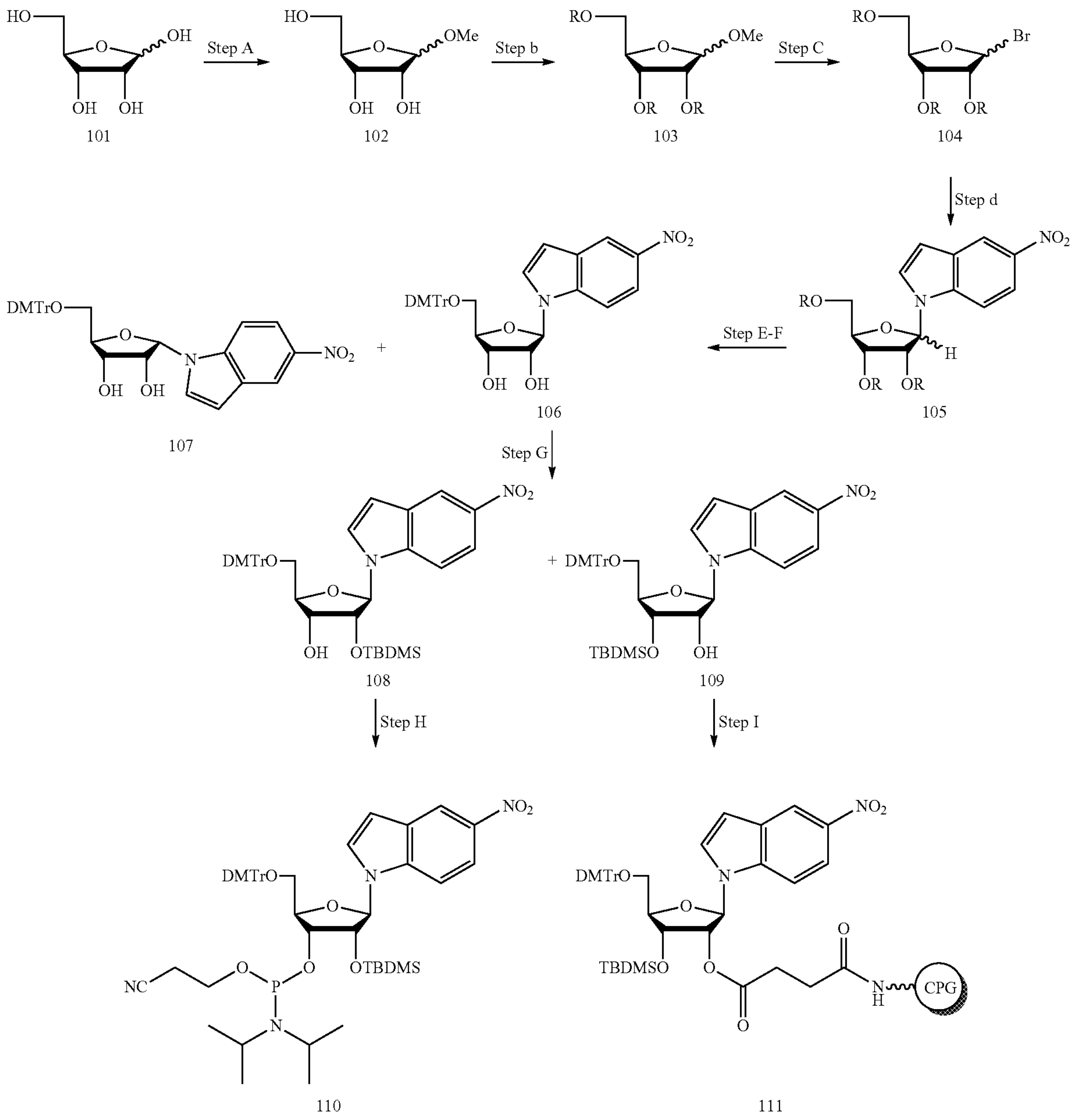

101 102 103 104 105 106 107 108 109 110 111

R = 2,4-Dichlorobenzyl

Step A: 1-O-Methyl-D-riboside (102)

To a solution of D-ribose (25 g) in dry methanol (300 mL) was added conc. sulfuric acid (1.88 mL) and stirred at room temperature for 3 days. The reaction mixture was then neutralized with 1 N sodium hydroxide solution and concentrated into a crude residue. The crude residue was dissolved in methanol (200 mL) and the solids were filtered off. The filtrate was concentrated into a crude residue, which was applied to a column of silica gel eluted with dichloromethane-methanol (5:1) to give a pure compound (23.0 g, 82%) as a syrup.

Step B: 1-O-Methyl-2,3,5-tri-O-(2,4-dichlorobenzyl)-D-riboside (103)

To a solution of 1-O-methyl-D-riboside (13.43 g, 81.83 mmol), 18-crown-6 (1.34 g) in dry THF (100 mL) was added powdered potassium hydroxide (69 g, 1.23 mol) and stirred at room temperature for 40 to 60 min. 2,4-Dichlorobenzyl chloride (51 mL, 368.2 mmol) was added dropwise and the reaction mixture was stirred at the same temperature overnight. The solids were filtered off and the filtrate was concentrated into a crude residue which was applied to a column of silica gel eluted with hexanes-ethyl acetate (4:1) to give a pure compound (48 g, 92%) as a white solid.

$^1$H-NMR ($CDCl_3$, 400 MHz): δ 7.46-7.34 (m, 5 H, ArH), 7.24-7.16 (m, 4 H, ArH), 4.99 (s, 1 H, H-1), 4.71 (dd, 2 H, $J_{gem}$=12.8 Hz, $OCH_2Ar$), 4.63-4.61 (m, 4 H, 2 $OCH_2Ar$), 4.38-4.36 (m, 1 H), 4.19-4.16 (dd, 1 H), 3.98 (d, 1 H, J=4.4 Hz), 3.75 (dd, 1 H, J=3.6, J=10.2 Hz, H-5a), 3.66 (dd, 1 H, J=3.6, J=10.4 Hz, H-5b), 3.37 (s, 3 H, $OCH_3$).

Step B: 1-Bromo-2,3,5-tri-O-(2,4-dichlorobenzyl)-D-ribose (104)

To a cold solution of 1-O-methyl-2,3,5-tri-O-(2,4-dichlorobenzyl)-D-riboside (3.22 g, 5.02 mmol) in dry dichloromethane (50 mL) cooled with ice-bath was added HOAc-HBr (5.3 mL, 30%) and stirred at 0-25° C. for 3 h. The reaction mixture was concentrated into a crude residue which was co-evaporated with toluene (3×30 mL) into a crude residue which was dried under a good vacuum and used for next reaction without purification and identification as a syrup.

Step D: 1-(5-Nitroindole)-2,3,5-tri-O-(2,4-dichlorobenzyl)-D-riboside (105)

To a solution of 5-nitroindole (2.44 g, 15.06 mmol) in dry $CH_3CN$ (30 mL) was added sodium hydride (602 mg, 15.06 mmol, 60%) and stirred at room temperature for 3-4 h under an argon atmosphere. The above obtained sugar donor (104) in dry $CH_3CN$ (10 mL) was added and stirred at the same temperature under an argon atmosphere overnight. The solids were filtered off and the filtrate was concentrated into a crude residue which was applied to a column of silica gel eluted with hexanes-ethyl acetate (3:1) to give a pure compound 105 (2.16 g, 60%) as a α and β mixture (1:1).

Steps E, F: 5'-O-(4,4'-dimethoxitrityl)-1'-(5-nitroindole)-D-riboside (106) and (107)

To a cold solution of 1-(5-nitroindole)-2,3,5-tri-O-(2,4-dichlorobenzyl)-D-riboside 105 (1.16 g, 1.51 mmol) in dry dichloromethane (100 mL) at −78° C. was added $BCl_3$ in dichloromethane (23 mL, 1.0M) and stirred at the same temperature for 2 h under an argon atmosphere and at −40° C. for 2 h. The reaction mixture was quenched with methanol-dichloromethane (1:1, 50 mL) and neutralized with ammonia-methanol solution. The solids were filtered off and the filtrate was concentrated into a crude residue which was applied to a column of silica gel eluted with dichloromethane-methanol (10:1) to give a pure compound (300 mg, 68%) as a α and β mixture (1:1). To a solution of the above obtained compound (840 mg, 2.86 mmol) in dry pyridine (3-4 ml) and DMAP (90 mg) was added DMTrC1 (1.06 g) and stirred at room temperature under an argon atmosphere overnight. The reaction mixture was concentrated into a crude residue which was applied to a column of silica gel eluted with hexanes-ethyl acetate (1:1) to give a pure compound 106 (550 mg) and compound 107 (190 mg), a mixture of compound 106 and 107 (360 mg).

Compound 106: $^1$H-NMR ($CDCl_3$, 2D g-COSY and 2D NOESY, 400 MHz): δ 8.49 (d, 1 H, J=1.6 Hz), 8.35 (d, 1 H), 8.03 (dd, 1 H, J=2.0, J=9.0 Hz), 7.70-7.69 (m, 2 H), 7.47-7.14 (m, 8 H, ArH), 6.86-6.81 (m, 5 H, ArH), 6.71 (d, 1 H, J=3.6 Hz), 6.41 (d, J=5.2 Hz, H'-1), 4.73 (t, 1 H, J=4.8 Hz, H'-2), 4.46-4.42 (m, 3H, H'-3, H'-4, H'-5), 3.79 (s, 6 H, 2$OCH_3$), 3.51 (dd, 1 H, J=3.2, J=10.4 Hz, H'-5a), 3.26 (dd, 1 H, J=3.2, J=10.6 Hz, H'-5b).

Compound 107: $^1$H-NMR ($CDCl_3$, 2D g-COSY and 2D NOESY, 400 MHz): δ 8.55 (d, 1 H, J=2.0 Hz), 7.98 (dd, 1 H, J=2.4, J=9.2 Hz), 7.60 (d, 1 H, J=9.2 Hz), 7.53 (d, 1 H, J=3.2 Hz), 7.44-7.42 (m, 2 H), 7.34-7.24 (m, 7 H, ArH), 6.84-6.81 (m, 4 H, ArH), 6.68 (d, 1H, J=3.2 Hz), 6.00 (d, 1 H, J=5.2 Hz, H'-1), 4.53 (t, 1 H, J=7.6 Hz), 4.46-4.44 (m, 1 H), 4.23-4.20 (m, 1 H), 3.80-3.76 (m, 7 H, 2$OCH_3$, H'-5), 3.55 (dd, 1 H, H'-5a), 3.43 (dd, 1 H, H'-5b).

Step G: 5'-O-(4,4'-dimethoxitrityl)-2'-O-(tert-butyldimethylsilyl)-1'-(5-nitroindole)-D-riboside (108) and 5'-O-(4,4'-dimethoxitrityl)-3'-O-(tert-butyldimethylsilyl)-1'-(5-nitroindole)-D-riboside (109)

To a solution of 5'-O-(4,4'-dimethoxitrityl)-1'-(5-nitroindole)-D-riboside (106) (550 mg, 0.92 mmol), $AgNO_3$ (188 mg, 1.104 mmol), and pyridine (0.74 mL, 9.2 mmol) in dry THF (9.2 mL) was added TBDMSC1 (188 mg, 1.196 mmol) and stirred at room temperature under an argon atmosphere overnight. The solids were filtered off and the filtrate was concentrated into a crude residue which was applied to a column of silica gel eluted with hexanes-ethyl acetate (4:1) to give a pure compound 108 (230 mg, 35%), compound 109 (150 mg, 23%), and a mixture of compound 108 and 109 (110 mg, 17%) in total yield of 75%.

Compound 108: $^1$H-NMR ($CDCl_3$, 2D g-COSY, 2D NOESY, 400 MHz): δ 8.56 (d, 1 H, J=2.4 Hz), 7.88 (dd, 1 H, J=2.4, J=8.8 Hz), 7.62 (d, 1 H, J=9.2 Hz), 7.54 (d, 1 H, J=3.6 Hz), 7.46-7.44 (m, 2 H), 7.36-7.25 (m, 6 H, ArH), 6.85-6.83 (d, 5 H, ArH), 6.69 (d, 1 H, J=3.6 Hz), 5.94 (d, 1 H, J=7.2 Hz, H'-1), 4.69 (dd, 1 H, H'-2), 4.31-4.29 (m, 2 H, H'-3, H'-4), 3.80 (s, 6 H, 2$OCH_3$), 3.58 (dd, 1 H, J=2.0, J=10.6 Hz, H'-5a), 3.40 (dd, 1 H, J=2.0, J=10.4 Hz, H'-5b), 2.85 (d, 1 H, J=0.8 Hz, 3'-OH), 0.78 (s, 9 H, t-Bu), −0.016 (s, 3 H, $SiCH_3$), −0.43 (s, 3 H, $SiCH_3$).

Compound 109: $^1$H-NMR ($CDCl_3$, 2D g-COSY, 2D NOESY, 400 MHz): δ 8.61 (d, 1 H, J=2.4 Hz), 8.05 (dd, 1 H, J=2.0, J=8.8 Hz), 7.69-7.65 (m, 2 H), 7.47-7.45 (m, 2 H, ArH), 7.36-7.27 (m, 5 H, ArH), 6.86-6.83 (m, 3 H, ArH), 6.71 (d, 1 H, J=3.2 Hz), 5.99 (d, 1H, J=4.8 Hz, H'-1), 4.51 (t, 1 H, J=4.8 Hz, J=5.6 Hz, H'-3), 4.40-4.36 (m, 1 H, H'-2), 4.17-4.15 (m, 2 H, H'-4, H'-5), 3.82 (s, 3 H, $OCH_3$), 3.81 (s, 3 H, $OCH_3$), 3.63 (dd, 1 H, J=2.4, J=11.0 Hz, H'-5a), 3.31 (dd, 1 H, J=2.8, J=11.0 Hz, H'-5b), 2.95 (d, 1 H, J=6.0 Hz, 2'-OH), 0.91 (s, 9H, t-Bu), 0.05 (s, 3 H, $SiCH_3$), 0.00 (s, 3 H, $SiCH_3$).

Step H: 5'-O-(4,4'-dimethoxitrityl)-2'-O-(tert-butyldimethylsilyl)-1'-(5-nitroindole)-D-riboside-3'-O-caynoethyl-N,N-diisopropylphosphoramidate (110)

2-Cyanoethyl-N,N-diisopropylchlorophosphoramidite (153 mg, 0.646 mmol) was added to a solution of 5'-O-(4,4'-dimethoxitrityl)-3'-O-(tert-butyldimethylsilyl)-1-(5-nitroindole)-D-βriboside 108 (230 mg, 0.323 mmol), diisopropylethylamine (306 uL, 1.78 mmol) and DMAP (10 mg) in dry dichloromethane (3 mL) and stirred at room temperature for 4-6 h under an argon atmosphere. The reaction mixture was concentrated to a crude residue which was applied to a column of silica gel which was saturated with 2% triethylamine in hexanes and eluted with hexanes-ethyl acetate (2:1) to give a pure title compound 110 (250 mg, 85%) as an amorphous solid.

$^{31}P$-NMR ($CDCl_3$, 400 MHz): δ 149.54 (s), 146.57 (s). Anal. Cald of $C_{50}H_{65}N_4O_9PSi$: 924.43. Found: 947.43 $[M+Na]^+$.

Step I: Solid supports of 2'-hydroxyl or 3'-hydroxyl of 5'-O-(4,4'-dimethoxitrityl)-1-(5-nitroindole)-D-riboside (111)

Succinic anhydride was added to a solution of a mixture of 2'-OTBDMS (108) or 3'-O-TBDMS of 5'-O-(4,4'-Dimethoxitrityl)-1-(5-nitroindole)-D-β-riboside (109), and DMAP in dry dichloromethane. The reaction mixture is stirred at room temperature under an argon atmosphere for 6 h. Another portion of succinct anhydrous and DMAP are added and stirred fot total of 16 h. The mixture is concentrated to a crude residue which is dissolved in ethyl acetate (50 ml), washed with citric acid (400 mg/20 ml), brine, and dried ($Na_2SO_4$). The organic layer is concentrated to a crude nucleoside succinate which was directly used for next reaction without further purification.

Nucleoside succinate, DMAP, DTNP, and $Ph_3P$ are agitated at room temperature for 20 min [Nucleoside and nucleotides, 1996, 15(4), 879-888.]. Then lcaa-CPG is added and agitated at the same temperature for 45 min. The solids are filtered off and washed with $CH_3CN$, dichloromethane, and ether. The solid supports are dried, capped under standard procedure, and washed to give solid support.

The nitroindole-comprising Controlled Glass Support and phosphoramidate thus obtained are employed in standard oligonucleotide synthesis as described above for oligonucleotides comprising natural bases.

Example 3 siRNA Testing In Vitro

The ability of the iRNA agents to inhibit replication of influenza virus was tested in human cell lines in vitro, or is tested in mice in vivo. The iRNA agent is transfected into the cells, e.g., by transfection or electroporation, allowed to act on the cells for a certain time, e.g., 24 hours, and levels of infectivity were determined by a plaque forming or ELISA assay. Complementing these direct assays, we tested the inhibition of target gene expression by RNAi Agents for several influenza genes recombinantly expressed in mammalian host cells.

Viruses and Cell Lines

Influenza virus A/PR/8/34 (PR8), subtype $H_1N_1$, was obtained from Charles River Laboratories (ATCC # VR-1469). A/WSN/33 (WSN), subtype $H_1N_1$, may be obtained from Thomas Chambers, University of Kentucky, Lexington, Ky. USA (see Castrucci, M. R., et al., J. Virol. 1992, 66:4647), or Dr. Peter Palese, Mount Sinai School of Medicine New York City, N.Y., USA (see WO 04/028471). Virus stocks were propagated in the allantoic cavity of embryonated hen eggs at 34° C. for 48-72 h (PR8) or 37° C. for 24 h (WSN) (Tompkins, S. M., et al. Proc. Natl. Acad. Sci. 2004, 101:8682).

MDCK cells were obtained from the American Type Culture Collection (ATCC, Rockville Md., USA; ATCC # CCL-34) and were grown in MEM containing 8% heat-inactivated fetal bovine serum (FBS), 2 mM L-glutamine, 1 mM Sodium Pyruvate, 1.5 g/L sodium bicarbonate and non-essential amino acids at 37° C. under a 5% $CO_2$/95% air atmosphere.

Vero E6 African green monkey kidney epithelial cells were obtained from ATCC (Rockville Md., USA, ATCC # CRL-1586) and were grown in DMEM supplemented with 4.5 g/l D-Glucose, 2 mM L-Glutamine, 110 mg/l sodium pyruvate, 10% fetal bovine serum (Hyclone, Cat # 30070.03) and 0.1% Penicillin/Streptomycin at 37° C. under a 5% $CO_2$/95% air atmosphere.

Cos-7 African green monke kidney cells were obtained from the German Collection of Microorganisms and Cell Cultures (DSMZ, Braunschweig, Germany, DSMZ # ACC 60) and were grown in Dulbecco's MEM, 10% fetal calf serum, 2 mM L-glutamine, 1.2 μg/ml sodium bicarbonate, 100 u penicillin/100 μg/ml streptomycin (Biochrom AG, Berlin, Germany).

Example 3.1

Plaque Forming Assay

Cell Culture, siRNA transfection, and virus infection.

MDCK cells were plated in 24-well plates at $7.5\times10^4$ cells per well in 0.5 ml growth medium a day before transfection. MDCK cells were 80% confluent the day of siRNA transfection. Before transfection cells are fed with 0.25 ml growth medium.

Prior to adding to cells, 1.5 ml (50 μl per well) Optimem I (Invitrogen) and 90 μl (3 μl per well) Lipofectamin 2000 (Invitrogen), the amount sufficient for transfection of one 24 well plate, were combined in a 2 ml Sarstedt tube and incubated for 10-15 minutes at room temperature. The appropriate amount of siRNA dissolved in annealing buffer is then added to the Optimem/lipofectamine 2000 mixture to give the desired final concentration, mixed, and incubated an additional 15-25 minutes at room temperature. Next, 50 μl of the siRNA/reagent complex is added dropwise to each well as dictated by the experimental design. Plates are then gently rocked to ensure complete mixing and incubated at 37° C. at 5% CO2/95% air for 14 hours.

Subsequently, the transfection medium was gently aspirated, cells washed once with 0.25-0.5 ml of PBS, and 100 μl of varying concentrations of PR8 in MEM medium was added to each well. After incubation at 37° C. for 1-2 hour, 0.5 ml of overlay media (MEM, 20 mM HEPES, 0.075% $NaHCO_3$, 2 mM glutamine, 0.6% agarose, 0.5 μg/ml TPCK-trypsin) were added, and plates incubated for 48 hrs at 37° C. in an incubator at 5% CO2/95% air. Plates were then fixed and immunostained for viral plaques as described below.

Immunostaining and Viral Quantitation 48 hours post-infection, cells were fixed in neutral buffered 10% formalin for 45 minutes, and wells rinsed with PBS. Wells were then blocked with permeabilization buffer (1×PBS, 2% FBS, 0.5% saponin, 0.1% sodium azide) for 15 minutes at room temperature, and 125 μl of a solution containing 0.5 μg/ml mouse anti-influenza A biotinylated antibody MAB8258B (Chemicon) was added. Following incubation for 1 hr at room temperature, wells were rinsed twice with PBS to remove unbound antibody, and 125 μl of a solution of 1 μg/ml of horse radish peroxidase (HRP) conjugated streptavidin (Vector Laboratories) in PBS per well was added, plates incubated for 45 min, and washed three times with PBS. 200 μl of TMB substrate (Vector Laboratories #SK-4400) per well were added. Following incubation for 5-10 minutes at room temperature in the dark, the colorimetric reaction was stopped with distilled water, the water discarded and the plates air-dried. Stained influenza plaques were counted by inverted light microscopy at 4× magnification. Plaque forming activity was compared to cells transfected with Lipofectamin only (mock-treated), and expressed in terms of [(plaque forming activity in treated cells)/(plaque forming activity in mock-treated cells)]×100=% remaining infectivity Example 3.2

ELISA Assay

MDCK or Vero cells were plated in 96-well plates at $10^4$ cells per well in 0.1 ml growth medium a day before transfection. The cells were 80% confluent the day of siRNA transfection. Before transfection, cells were fed with 44 μl growth medium.

1.08 ml (9 μl per well) Optimem I (Invitrogen) and 42 μl (0.35 μl per well) Lipofectamin 2000 (Invitrogen), the amount sufficient for transfection of one 96 well plate, were combined in a 2 ml Sarstedt tube and incubated for 10-15 minutes at room temperature. The appropriate amount of siRNA dissolved in annealing buffer was then added to the Optimem/lipofectamine 2000 mixture to give the desired final concentration, mixed, and incubated an additional 15-25 minutes at room temperature. Next, 10 μl of the siRNA/reagent complex was added to each well as dictated by the experimental design. Plates were gently rocked to ensure complete mixing and then incubated at 37° C. in an incubator at 5% $CO_2$/95% air for 14 hours.

Subsequently, cells were washed once with PBS, infected with PR8 influenza virus in 50 μl of MEM per well, and incubated for 1-2 hours. Thereafter, plates were washed once with PBS, and 200 μl of MEM with 0.25/0.5 μg/ml (MDCK/VERO, respectively) of trypsin were added. Two days post infection, plates were fixed in 10% Buffered Formalin for 15 min. Cells were rinsed with PBS, blocked with blocking buffer for 15 min. at RT, and 50 μl of a solution containing 0.5 μg/ml of biotinylated anti-influenza A monoclonal antibody MAB8258B (Chemicon) per well were added. Plates were incubated at RT for 1 hour, washed twice with PBS, and 50 μl per well of a solution containing 1 μg/ml of AP-conjugated streptavidin (Vector Laboratories) in blocking buffer was added. After incubation for 45 min and washing 3× with PBS, 100 μl per well of pNPP substrate solution was added. Plates were developed at RT in the dark and read at 405 nm.

Example 3.3

Inhibition of Recombinantly Expressed Influenza Target Genes by siRNA

Consensus sequences of MP (SEQ ID NO: 1453), NP (SEQ ID NO: 1454), PA (SEQ ID NO: 1455), PB1 (SEQ ID NO: 1456) and PB2 (SEQ ID NO: 1457) (see Table 5) were synthesized by GENEART (Regensburg, Germany) and cloned into GENEART standard vectors. MP and PA were subcloned into psiCheck-2 (Promega, Mannheim, Germany) via AsiSI and NotI (both NEBn, Frankfurt, Germany) sites, NP, (PB1) and PB2 via XhoI and NotI, resulting in a construct with the flu gene between the stop-codon and the polyA-signal of Renilla luciferase. Correct cloning was confirmed by end sequencing performed by GATC Biotech (Konstanz, Germany).

Transfections:

Cos-7 cells were seeded at $1.5 \times 10^4$ cells/well on white 96-well plates with clear bottom (Greiner Bio-One GmbH, Frickenhausen, Germany) in 75 μl of growth medium. Directly after seeding the cells, 50 ng of plasmid/well were transfected with Lipofectamine-2000 (Invitrogen) as described below for the siRNAs, with the plasmid diluted in Opti-MEM to a final volume of 12.5 μl/well, prepared as a mastermix for the whole plate.

siRNA transfections were performed in quadruplicates 4 h after plasmid transfection. For each well 0.5 μl Lipofectamine-2000 (Invitrogen GmbH, Karlsruhe, Germany) were mixed with 12 μl Opti-MEM (Invitrogen) and incubated for 15 min at room temperature. For an siRNA concentration of 50 nM in the 100 μl transfection volume, 1 μl of a 5 μM siRNA were mixed with 11.5 μl Opti-MEM per well, combined with the Lipofectamine-2000-Opti-MEM mixture and again incubated for 15 minutes at room temperature. During incubation, the growth medium was removed from cells and replaced by 75 μl/well of fresh medium. siRNA-Lipofectamine-2000-complexes were applied completely (25 μl each per well) to the cells and cells were incubated for 24 h at 37° C. and 5% $CO_2$ in a humidified incubator (Heraeus GmbH, Hanau, Germany).

Cells were harvested by removing growth medium and application of 150 μl of a 1:1 mixture consisting of medium and Dual-Glo Luciferase substrate, from the Dual-Glo Luciferase Assay System (Promega, Mannheim, Germany). The luciferase assay was performed according to the manufacturer's protocol for Dual-Glo Luciferase assay and luminescence was measured in a Victor-Light 1420 Luminescence Counter (Perkin Elmer, Rodgau-Jügesheim, Germany). Values obtained with Renilla luciferase were normalized to the respective values obtained with Firefly luciferase. Values acquired with siRNAs directed against an influenza gene were normalized to the value obtained with an unspecific siRNA (directed against neomycin resistance gene) set to 100%.

Effective siRNAs from the screen were further characterized by dose response curves. Transfections of dose response curves were performed at the following siRNA concentrations according to the above protocol: 100 nM, 25 nM, 6.3 nM, 1.6 nM, 400 pM, 100 pM, 24 pM, 6 pM, 1.5 pM, 380 fM. $IC_{50}$ values determined by parametrized curve fitting using the program XLfit.

TABLE 5

| Virtual consensus sequences for influenza genes MP (SEQ ID NO: 1453), NP (SEQ ID NO: 1454), PA (SEQ ID NO: 1455), PB1 (SEQ ID NO: 1456) and PB2 (SEQ ID NO: 1457) for cloning into Cos-7 cells |
|---|
| MP: virtual consensus derived from gi\|13383290\|gb\|AB049165\|Influenza A virus (A/parakeet/Chiba/1/97(H9N2)) M1, M2 genes for membrane ion channel, matrix protein, complete cds. |

SEQ ID NO: 1453

```
ATGAGTCTTC TAACCGAGGT CGAAACGTAC GTTCTCTCTA TCATCCCGTC AGGCCCCCTC    60

AAAGCCGAGA TCGCGCAGAG ACTTGAAGAT GTCTTTGCAG AGAAGAACAC AGATCTCGAG   120
```

TABLE 5-continued

| Virtual consensus sequences for influenza genes MP (SEQ ID NO: 1453), NP (SEQ ID NO: 1454), PA (SEQ ID NO: 1455), PB1 (SEQ ID NO: 1456) and PB2 (SEQ ID NO: 1457) for cloning into Cos-7 cells |
|---|
| GCTCTCATGG AATGGCTAAA GACAAGACCA ATCCTGTCAC CTCTGACTAA GGGGATTTTA 180 |
| GGGTTTGTGT TCACGCTCAC CGTGCCCAGT GAGCGAGGAC TGCAGCGTAG ACGCTTTGTC 240 |
| CAGAATGCCC TAAATGGGAA TGGAGACCCA AACAACATGG ACAGGGCAGT TAAACTATAC 300 |
| AAGAAGCTGA AGAGGGAAAT AACATTCCAT GGGGCTAAGG AAGTTGCACT CAGTTACTCT 360 |
| GCTGGTGCAC TTGCCAGTTG CATGGGTCTC ATATACAACC GGATGGGAAC AGTGACCACA 420 |
| GAAGTGGCTC TTGGCCTAGT GTGTGCCACT TGTGAGCAGA TTGCAGATTC ACAACATCGG 480 |
| TCCCACAGGC AGATGGCGAC TACCACCAAC CCACTAATCA GACATGAGAA CAGAATGGTG 540 |
| CTGGCCAGCA CTACAGCTAA GGCTATGGAG CAGATGGCTG GATCAAGTGA GCAGGCAGCG 600 |
| GAAGCCATGG AAGTCGCAAG TCAGGCTAGG CAGATGGTGC AGGCAATGAG GACAATTGGG 660 |
| ACTCATCCTA GCTCCAGTGC AGGTCTAAAA GATAATCTTC TTGAAAATTT GCAGGCCTAC 720 |
| CAGAAACGAA TGGGGGTGCA GATGCAGCGA TTCAAGTGAT CCTCTCGTTG TTGCAGCAAG 780 |
| TATCATTGGG ATCTTGCACT TGATATTGTG GATTCTTGAT CGTCTTTTCT TCAAATGCAT 840 |
| TTATCGTCGC CTTAAATACG GTTTGAAAAG AGGGCCTTCT ACGGAAGGAG TACCTGAGTC 900 |
| TATGAGGGAA GAGTATCGAC AGGAACAGCA GAGTGCTGTG GATGTTGACG ATGGTCATTT 960 |
| TGTCAACATA GAGCTGGAGT AA 982 |
| NP: virtual consensus derived from H5N1 gi\|14326108\|AF370122\|Influenza A virus (A/Goose/Guangdong/3/97(H5N1)) nucleoprotein gene, complete cds. |
| SEQ ID NO: 1454 |
| CTCACTGAGT GACATCAAAA TCATGGCGTC TCAAGGCACC AAACGATCTT ATGAACAGAT 60 |
| GGAAACTGGT GGAGAACGCC AGAATGCTAC TGAGATCAGA GCATCTGTTG GAAGAATGGT 120 |
| TGGTGGAGTT GGGAGGTTTT ATATACAGAT GTGCACTGAA CTCAAACTCA GCGACTATGA 180 |
| AGGAAGGCTG ATTCAGAACA GCATAACAAT AGAGAGAATG GTTGTCTCTG CATTTGATGA 240 |
| AAGGAGGAAC AAATACCTGG AAGAACATCC CAGTGCGGGG AAGGACCCAA AGAAAACTGG 300 |
| AGGTCCAATC TACCGAAGAA GAGACGGGAA ATGGGTGAGA GAGCTGATTC TGTATGACAA 360 |
| AGAGGAGATC AGGAGAATTT GGCGTCAAGC GAACAATGGA GAAGATGCAA CTGCTGGTCT 420 |
| CACTCACCTG ATGATCTGGC ATTCCAATCT AAATGATGCC ACATACCAGA GAACAAGAGC 480 |
| TCTCGTGCGT ACTGGGATGG ACCCTAGAAT GTGCTCTCTG ATGCAAGGAT CAACTCTCCC 540 |
| GAGGAGATCT GGAGCTGCTG GTGCGGCAGT AAAGGGAGTC GGAACTATGG TGATGGAACT 600 |
| AATTCGGATG ATAAAGCGAG GGATTAACGA TCGGAATTTC TGGAGAGGTG AAAATGGGCG 660 |
| AAGAACAAGG ATTGCATATG AGAGAATGTG CAACATTCTC AAAGGGAAAT TCCAAACAGC 720 |
| AGCACAAAGA GCAATGATGG ATCAGGTACG GGAAAGCAGA AATCCTGGGA ATGCTGAGAT 780 |
| CGAAGATCTC ATATTTCTGG CACGGTCTGC ACTCATCCTG AGAGGATCAG TGGCCCACAA 840 |
| GTCCTGCTTG CCTGCTTGTG TGTACGGGCT TGCCGTGGCC AGTGGATATG ACTTTGAGAG 900 |
| AGAAGGGTAC TCTCTGGTCG GGATTGATCC TTTCCGTCTG CTGCAAAACA GCCAGGTCTT 960 |
| TAGTCTAATT AGACCAAATG AGAATCCAGC ACATAAAAGT CAATTGGTGT GGATGGCATG 1020 |
| CCATTCTGCA GCATTTGAAG ATCTGAGAGT CTCAAGCTTC ATCAGAGGGA CAAGAGTGGC 1080 |
| CCCAAGGGGA CAACTATCTA CTAGAGGAGT ACAAATTGCT TCAAATGAGA ACATGGAAAC 1140 |
| AATGGACTCC AGCACTCTTG AACTGAGAAG CAGATATTGG GCTATAAGGA CCAGGAGTGG 1200 |

TABLE 5-continued

Virtual consensus sequences for influenza genes MP (SEQ ID NO: 1453), NP (SEQ ID NO: 1454), PA (SEQ ID NO: 1455), PB1 (SEQ ID NO: 1456) and PB2 (SEQ ID NO: 1457) for cloning into Cos-7 cells

AGGAAACACC AACCAGCAGA GAGCATCTGC AGGACAAATC AGTGTGCAGC CTACTTTCTC 1260

GGTACAGAGA AATCTTCCCT TCGAAAGAGC GACCATTATG GCGGCATTCA CAGGGAATAC 1320

AGAGGGCAGA ACATCTGACA TGAGGACTGA AATCATAAGG ATGATGGAAA GCTCCAGACC 1380

AGAAGATGTG TCTTTCCAGG GGCGGGGAGT CTTCGAGCTC TCGGACGAAA AGGCAACGAA 1440

CCCGATCGTG CCTTCCTTTG ACATGAGTAA TGAAGGATCT TATTTCTTCG GAGACAATGC 1500

AGAGGAGTAT GACAATTGAA G 1521

PA: virtual consensus derived from H5N1gi|47156500|AY585473|Influenza A virus (A/duck/Guangxi/35/2001(H5N1)) polymerase (PA) mRNA, complete cds.

SEQ ID NO: 1455

ATGGAAGACT TTGTGCGACA ATGCTTCAAT CCAATGATTG TCGAGCTTGC GGAAAAGGCA 60

ATGAAAGAAT ATGGGGAAGA TCCGAAAATC GAAACGAACA AATTTGCAGC AATATGCACA 120

CACTTAGAAG TCTGTTTCAT GTATTCAGAT TTTCACTTTA TTGATGAACG GGGCGAATCA 180

ATAATTGTAG AATCTGGCGA TCCGAATGCA TTATTGAAAC ACCGATTTGA AATAATTGAA 240

GGAAGAGACC GAACAATGGC CTGGACAGTG GTGAATAGTA TCTGCAACAC CACAGGAGTT 300

GAGAAACCTA AATTTCTCCC AGATTTGTAT GACTACAAAG AGAACCGATT CATTGAAATT 360

GGAGTGACAC GGAGGGAAGT TCATATATAC TATCTAGAGA AAGCCAACAA GATAAAATCC 420

GAGAAGACAC ACATTCACAT ATTCTCATTC ACTGGGGAGG AAATGGCCAC CAAAGCGGAC 480

TACACCCTTG ATGAAGAGAG CAGGGCAAGA ATCAAAACCA GGCTGTTCAC CATAAGGCAG 540

GAAATGGCCA GTAGGGGTCT ATGGGATTCC TTTCGTCAGT CCGAGAGAGG CGAAGAGACA 600

ATTGAAGAAA GATTTGAAAT CACAGGAACC ATGCGCAGGC TTGCCGACCA AAGTCTCCCA 660

CCGAACTTCT CCAGCCTTGA AAACTTTAGA GCCTATGTGG ATGGATTCGA ACCGAACGGC 720

TGCATTGAGG GCAAGCTTTC TCAAATGTCA AAAGAAGTGA ACGCCAGAAT TGAGCCATTT 780

CTGAAGACAA CACCACGCCC TCTCAGATTA CCTGATGGGC CTCCCTGCTC TCAGCGGTCG 840

AAGTTCTTGC TGATGGATGC CCTTAAATTA AGCATCGAAG ACCCGAGTCA TGAGGGGGAG 900

GGGATACCGC TATATGATGC AATCAAATGC ATGAAAACAT TTTTCGGCTG GAAAGAGCCC 960

AACATCGTAA AACCACATGA AAAAGGCATA AACCCCAATT ACCTCCTGGC TTGGAAGCAA 1020

GTGCTGGCAG AACTCCAAGA TATTGAAAAT GAGGAGAAAA TCCCAAAAAC AAAGAACATG 1080

AAGAAAACAA GCCAATTGAA GTGGGCACTC GGTGAGAACA TGGCACCAGA GAAAGTAGAC 1140

TTTGAGGATT GCAAAGATGT TAGCGATCTA AGACAGTATG ACAGTGATGA ACCAGAGCCT 1200

AGATCACTAG CAAGCTGGAT CCAGAGTGAA TTCAACAAGG CATGTGAATT GACAGATTCG 1260

AGTTGGATTG AACTTGATGA AATAGGGGAA GACGTTGCTC CAATTGAGCA CATTGCAAGT 1320

ATGAGAAGGA ACTATTTCAC AGCGGAAGTA TCCCATTGCA GGGCCACTGA ATACATAATG 1380

AAGGGGGTGT ACATAAACAC AGCTCTGTTG AATGCATCCT GTGCAGCCAT GGATGACTTT 1440

CAACTGATTC CAATGATAAG CAAATGCAGA ACCAAAGAAG GAAGACGGAA AACTAACCTG 1500

TATGGATTCA TTATAAAAGG AAGATCCCAT TTGAGGAATG ATACCGATGT GGTAAACTTT 1560

GTGAGTATGG AATTCTCTCT TACTGACCCG AGGCTGGAGC CACACAAGTG GGAAAAGTAC 1620

TGTGTTCTCG AGATAGGAGA CATGCTCCTA CGGACTGCAA TAGGCCAAGT TTCAAGGCCC 1680

ATGTTCCTGT ATGTGAGAAC CAATGGAACC TCCAAGATCA AAATGAAATG GGGAATGGAG 1740

ATGAGGCGAT GCCTTCTTCA ATCCCTTCAA CAGATTGAGA GCATGATTGA GGCCGAGTCT 1800

TABLE 5-continued

Virtual consensus sequences for influenza genes MP (SEQ ID NO: 1453), NP (SEQ ID NO: 1454), PA (SEQ ID NO: 1455), PB1 (SEQ ID NO: 1456) and PB2 (SEQ ID NO: 1457) for cloning into Cos-7 cells

```
TCTGTCAAAG AGAAAGACAT GACCAAAGAA TTCTTTGAAA ACAAATCAGA AACATGGCCA  1860
ATTGGAGAGT CACCCAAAGG AGTGGAGGAA GGCTCCATCG GGAAGGTGTG CAGAACCTTA  1920
CTGGCGAAAT CTGTGTTCAA CAGTCTATAT GCATCTCCAC AACTCGAGGG GTTTTCAGCT  1980
GAATCAAGAA AATTGCTTCT CATTGTTCAG GCACTTAGGG ACAACCTGGA ACCTGGGACC  2040
TTCGATCTTG GAGGGCTATA TGAAGCAATT GAGGAGTGCC TGATTAATGA TCCCTGGGTT  2100
TTGCTTAATG CGTCTTGGTT CAACTCCTTC CTCACACATG CACTGAAATA GTT         2153
```

PB1: virtual consensus derived from H5N1gi|58531084|AB166860|Influenza A virus (A/chicken/Yamaguchi/7/2004(H5N1)) PB1 gene for polymerase basic protein 1, complete cds.

SEQ ID NO: 1456

```
ATGGATGTCA ATCCGACTTT ACTTTTCTTG AAAGTACCAG TGCAAAATGC TATAAGTACC    60
ACATTCCCTT ATACTGGAGA CCCTCCATAC AGCCATGGAA CAGGGACAGG ATACACCATG   120
GACACAGTCA ACAGAACACA CCAATATTCA GAAAAGGGGA AGTGGACAAC AAACACAGAG   180
ACTGGAGCAC CCCAACTCAA CCCGATTGAT GGACCACTAC CTGAGGATAA TGAGCCCTGT   240
GGGTATGCAC AAACAGATTG TGTATTGGAA GCAATGGCTT TCCTTGAAGA ATCCCACCCA   300
GGGATCTTTG AAAACTCGTG TCTTGAAACG ATGGAAATTG TTCAACAAAC AAGAGTGGAT   360
AAACTGACCC AAGGTCGCCA GACCTATGAC TGGACATTGA ATAGAAACCA ACCGGCTGCA   420
ACTGCTTTGG CCAACACTAT AGAAATCTTC AGATCGAACG GTCTAACAGC CAATGAATCG   480
GGACGGCTAA TAGATTTCCT CAAGGATGTG ATGGAATCAA TGGATAAGGA AGAAATGGAG   540
ATAACAACAC ATTTCCAGAG AAAGAGAAGA GTGAGGGACA ACATGACCAA GAAAATGGTC   600
ACACAAAGAA CAATAGGGAA GAAAAAACAA AGGCTGAACA AAAAGAGCTA CCTGATAAGA   660
GCACTGACAC TGAACACAAT GACAAAAGAT GCAGAAAGAG GCAAATTGAA GAGGCGAGCA   720
ATTGCAACAC CCGGAATGCA AATCAGAGGA TTCGTGTACT TTGTTGAAAC ACTAGCGAGG   780
AGTATCTGTG AGAAACTTGA GCAATCTGGA CTCCCAGTCG GAGGGAATGA GAAGAAGGCT   840
AAATTGGCAA ACGTCGTGAG GAAGATGATG ACTAACTCAC AAGATACTGA ACTCTCCTTT   900
ACAATTACTG GAGACAATAC CAAATGGAAT GAGAATCAGA ATCCTAGGAT GTTTCTGGCA   960
ATGATAACGT ACATCACAAG GAACCAGCCA GAATGGTTTC GGAATGTCTT AAGCATTGCC  1020
CCTATAATGT TCTCAAACAA AATGGCGAGA TTAGGAAAAG GATACATGTT CGAAAGTAAG  1080
AGCATGAAGT TACGAACACA AATACCAGCA GAAATGCTTG CAAACATTGA TCTCAAATAC  1140
TTCAATGAAT TAACGAAAAA GAAAATTGAG AAAATAAGAC CTCTATTAAT AGATGGTACA  1200
GCCTCATTGA GCCCTGGAAT GATGATGGGC ATGTTCAACA TGCTGAGTAC AGTCCTAGGA  1260
GTCTCAATCC TGAATCTTGG ACAGAAAAGG TACACCAAAA CCACATATTG GTGGGACGGA  1320
CTCCAATCCT CTGATGATTT CGCTCTCATC GTAAATGCAC CGAATCATGA GGGAATACAA  1380
GCAGGAGTGG ATAGGTTTTA TAGGACTTGT AAACTAGTTG GAATCAATAT GAGCAAGAAG  1440
AAGTCTTACA TAAATCGGAC AGGGACATTT GAATTCACGA GCTTTTTCTA CCGCTATGGA  1500
TTTGTAGCCA ATTTCAGTAT GGAGCTGCCC AGTTTTGGAG TGTCTGGAAT TAATGAATCG  1560
GCCGACATGA GCATTGGTGT TACAGTGATA AAGAACAATA TGATAAACAA CGACCTTGGG  1620
CCAGCAACAG CTCAGATGGC TCTTCAGCTA TTCATCAAGG ACTACAGATA CACATACCGA  1680
TGCCACAGAG GGGATACGCA AATCCAAACG AGGAGATCAT TCGAGCTGAA GAAGCTGTGG  1740
```

TABLE 5-continued

Virtual consensus sequences for influenza genes MP (SEQ ID NO: 1453), NP (SEQ ID NO: 1454), PA (SEQ ID NO: 1455), PB1 (SEQ ID NO: 1456) and PB2 (SEQ ID NO: 1457) for cloning into Cos-7 cells

```
GAGCAAACCC GTTCAAAGGC AGGACTGTTG GTTTCAGATG GAGGACCAAA TCTATACAAT  1800
ATCCGAAATC TCCATATTCC TGAGGTCTGC TTAAAATGGG AATTGATGGA TGAAGATTAC  1860
CAGGGCAGAC TGTGTAATCC TCTGAATCCG TTCGTCAGCC ATAAGGAAAT TGAATCTGTC  1920
AACAATGCTG TAGTAATGCC AGCTCATGGC CCGGCCAAAA GCGTGGAATA TGATGCCGTT  1980
GCAACTACAC ATTCATGGAT TCCTAAAAGG AATCGTTCCA TTCTCAATAC GAGTCAAAGG  2040
GGAATTCTTG AGGATGAACA GATGTACCAG AAGTGCTGCA ATCTATTCGA GAAATTCTTC  2100
CCCAGCAGTT CATATCGGAG GCCAGTTGGA ATTTCCAGCA TGGTGGAGGC CATGGTGTCT  2160
AGGGCCCGAA TTGACGCACG AATTGATTTC GAGTCTGGAA GGATTAAGAA AGAAGAGTTT  2220
GCTGAGATCA TGAAGATCTG TTCCACCATT GAAGAGCTCA GACGGCAAAA ATAG        2274
```

PB2: virtual consensus derived from H5N1gi|19697859|AY059525|Influenza A virus (A/Duck/Hong Kong/2986.1/2000(H5N1)) segment 1 polymerase (PB2) gene, partial cds.

SEQ ID NO: 1457

```
ATGGAGAGAA TAAAAGAATT AAGAGATCTA ATGTCGCAGT CTCGCACTCG CGAGATACTA    60
ACAAAAACCA CTGTGGACCA TATGGCCATA ATCAAGAAAT ACACATCAGG AAGACAAGAG   120
AAGAACCCTG CTCTCAGAAT GAAATGGATG ATGGCAATGA AATATCCAAT CACAGCAGAC   180
AAGAGAATAA TAGAGATGAT TCCTGAAAGG AATGAACAAG GGCAGACGCT TTGGAGCAAG   240
ACAAATGATG CTGGATCGGA CAGGGTGATG GTGTCTCCCC TAGCTGTAAC TTGGTGGAAT   300
AGGAATGGGC CGACGACAAG TGCAGTCTAT TATCCAAAGG TTTACAAAAC ATACTTTGAG   360
AAGGTTGAAA GGTTAAAACA TGGAACCTTC GGTCCCGTTC ATTTCCGAAA CCAAATTAAA   420
ATACGCCGCC GAGTTGATAT AAATCCTGGC CATGCAGATC TCAATGCTAA AGAAGCACAA   480
GATGTCATCA TGGAGGTCGT TTTCCCAAAT GAAGTGGGAG CTAGAATATT GACATCAGAG   540
TCGCAATTGA CAATAACGAA AGAAAAGAAA GAAGAGCTCC AGGATTGTAA GATTGCTCCT   600
TTAATGGTTG CATACATGTT GGAAAGGGAA CTGGTCCGCA AAACCAGATT CCTACCGGTA   660
GCAGGCGGAA CAAGCAGTGT GTACATTGAG GTATTGCATT TGACTCAAGG GACCTGCTGG   720
GAACAGATGT ACACTCCAGG CGGAGAAGTG AGAAATGACG ATGTTATCCA GAGTATGATC   780
ATCGCTGCCA GAAACATTGT TAGGAGAGCA ACGGTATCAG CGGATCCACT GGCATCACTG   840
CTGGAGATGT GTCACAGCAC ACAAATTGGT GGGATAAGGA TGGTGGACAT CCTTAGGCAA   900
AATCCAACTG AGGAACAAGC TGTGGATATA TGCAAAGCAG CAATGGGTTT GAGGATCAGT   960
TCATCCTTTA GCTTTGGAGG CTTCACTTTC AAAAGAACAA GTGGAACATC CGTCAAGAAG  1020
GAAGAGGAAG TGCTTACAGG CAACCTCCAA ACATTGAAAA TAAGAGTACA TGAGGGGTAT  1080
GAGGAATTCA CAATGGTTGG GCGGAGGGCA ACAGCTATCC TGAGGAAAGC AACTAGAAGG  1140
CTGATTCAGT TGATAGTAAG TGGAAGAGAC GAACAATCAA TCGCTGAGGC AATCATTGTA  1200
GCAATGGTGT TCTCACAGGA GGATTGCATG ATAAAGGCAG TCCGAGGCGA TCTGAATTTC  1260
GTAAACAGAG CAAACCAAAG ATTAAACCCC ATGCATCAAC TCCTGAGACA TTTTCAAAAG  1320
GATGCAAAAG TGCTATTTCA GAATTGGGGA ATTGAACCCA TTGATAATGT CATGGGGATG  1380
ATCGGAATAT TACCTGACAT GACTCCCAGC ACAGAAATGT CACTGAGAGG AGTAAGAGTT  1440
AGTAAAATGG GAGTGGATGA ATATTCCAGC ACTGAGAGAG TAGTTGTAAG TATTGACCGT  1500
TTCTTAAGGG TTCGAGATCA GCGGGGGAAC GTACTCTTAT CTCCCGAAGA GGTCAGCGAA  1560
```

TABLE 5-continued

| Virtual consensus sequences for influenza genes MP (SEQ ID NO: 1453), NP (SEQ ID NO: 1454), PA (SEQ ID NO: 1455), PB1 (SEQ ID NO: 1456) and PB2 (SEQ ID NO: 1457) for cloning into Cos-7 cells |
|---|
| ACACAGGGAA CAGAGAAATT GGCAATAACA TATTCATCAT CAATGATGTG GGAAATCAAC 1620 |
| GGTCCTGAGT CAGTGCTTGT TAACACCTAT CAATGGATCA TCAGAAACTG GGAGACTGTG 1680 |
| AAGATTCAAT GGTCTCAAGA CCCCACGATG CTGTACAATA AGATGGAGTT TGAACCGTTC 1740 |
| CAATCCTTGG TACCTAAAGC TGCCAGAGGT CAATACAGTG GATTTGTGAG AACACTATTC 1800 |
| CAACAAATGC GTGACGTACT GGGGACATTT GATACTGTCC AGATAATAAA GCTGCTACCA 1860 |
| TTTGCAGCAG CCCCACCGGA GCAGAGCAGA ATGCAGTTTT CTTCTCTAAC TGTGAATGTG 1920 |
| AGAGGCTCAG GAATGAGAAT ACTTGTAAGG GGCAATTCCC CTGTGTTCAA CTACAATAAG 1980 |
| GCAACCAAAA GGCTTACCGT TCTTGGAAAG GACGCAGGTG CATTAACAGA GGATCCAGAT 2040 |
| GAGGGAACAG CCGGAGTGGA ATCTGCAGTA CTGAGGGGAT TCCTAATTCT AGGCAAGGAG 2100 |
| GACAAAAGAT ATGGACCAGC ATTGAGCATC AATGAACTGA GCAATCTTGC GAAAGGGGAG 2160 |
| AAAGCTAATG TGCTGATAGG GCAAGGAGAC GTGGTGTTGG TAATGAAACG GAAACGGGAC 2220 |
| TCTAGCATAC TTACTGACAG CCAGACAGCG ACCAAAAGAA TTCGGATGGC CATCAATTAG 2280 |

Table 1A, C, D and E list the duplex identifier, the sequences of sense and antisense strand, the agents' target genes, and the results from the above assays, where performed, for selected exemplary agents of the invention. Table 1B and H list the duplex identifier, the duplex identifier of the corresponding unmodified sequence, the sequences of sense and antisense strand, and the agents' target genes, for selected exemplary agents bearing modified nucleic acids groups, in order to stabilize these agents against degradation, in which all pyrimidine base comprising nucleotides comprised a 2'-O-methyl group in the sense strand, and all pyrimidine base comprising nucleotides in a sequence context of 5'-ca-3' or 5'-ua-3' comprised a 2'-O-methyl group in the antisense strand, except for those agents where the antisense strand does not comprise nucleotides in a sequence context of 5'-ca-3' or 5'-ua-3', in which all uridines in a sequence context of 5'-ug-3' are 2'-O-methyl-modified nucleotides in the antisense strand (e.g. AL-DP-2295, AL-DP-2301, and AL-DP-2302). Table 2 lists concentrations at 50% maximal inhibition calculated from the dose response determinations in Cos-7 cells engineered to express influenza genes for some particularly preferred RNAi agents of the invention.

TABLE 6

| Sequences used in analysis of Influenza A Matrix Protein (MP) | |
|---|---|
| AY180470 | Influenza A virus strain A/Quail/Nanchang/12-340/2000 (H1N1) matrix protein (M) gene, partial cds. |
| AY633213 | Influenza A virus (A/mallard/Alberta/211/98(H1N1)) matrix protein (M) gene, complete cds. |
| AY664487 | Influenza A virus (A/mallard/Alberta/119/98 (H1N1)) nonfunctional matrix protein mRNA, partial sequence. |
| M55476 | Influenza virus type A matrix protein (M1) gene, complete cds and M2 protein (M2) gene, complete cds. |
| M55479 | Influenza virus type A matrix protein (M1) gene, complete cds and M2 protein (M2) gene, complete cds. |
| M55480 | Influenza virus type A matrix protein (M1) gene, complete cds and M2 protein (M2) gene, complete cds. |
| M63528 | Influenza A virus (A/turkey/Minnesota/166/81 (H1N1)) membrane protein M1 and membrane protein M2 genes, complete cds. |
| U49119 | Influenza A virus matrix proteins M1 and M2 (M) gene, complete cds. |
| Z26859 | Influenza virus type A M and M2 genes for matrix proteins |
| Z26860 | Influenza virus type A M and M2 genes for matrix proteins |
| AY422021 | Influenza A virus (A/duck/Hokkaido/95/01(H2N2)) matrix protein 1 (M) gene, partial cds. |
| M12699 | Avian influenza A/Mallard/NY/6750/78 RNA segment 7 encoding M1 and M2 proteins, complete cds. |
| AF213915 | Influenza A virus (A/Chicken/Italy/5945/95(H3N2)) segment 7 matrix protein (M) gene, partial cds. |
| AY180498 | Influenza A virus strain A/Chicken/Nanchang/3-120/2001 (H3N2) matrix protein (M) gene, partial cds. |
| AY664458 | Influenza A virus (A/ruddy turnstone/Delaware/142/99 (H3N2)) nonfunctional matrix protein mRNA, partial sequence. |
| AY769614 | Influenza A virus (A/turkey/Ohio/313053/04(H3N2)) matrix protein gene, partial cds. |

TABLE 6-continued

| | |
|---|---|
| AY779257 | Influenza A virus (A/turkey/North Carolina/12344/03(H3N2)) matrix protein 2 (M) gene, partial cds; and matrix protein 1 (M) gene, complete cds. |
| AY779258 | Influenza A virus (A/turkey/Minnesota/764-2/03(H3N2)) matrix protein 2 (M) gene, partial cds; and matrix protein 1 (M) gene, complete cds. |
| AY862623 | Influenza A virus (A/chicken/Korea/S6/03(H3N2)) matrix protein (M) gene, complete cds. |
| AY862624 | Influenza A virus (A/duck/Korea/S7/03(H3N2)) matrix protein (M) gene, complete cds. |
| AY862625 | Influenza A virus (A/duck/Korea/S8/03(H3N2)) matrix protein (M) gene, complete cds. |
| AY862626 | Influenza A virus (A/duck/Korea/S9/03(H3N2)) matrix protein (M) gene, complete cds. |
| AY862627 | Influenza A virus (A/duck/Korea/S10/03(H3N2)) matrix protein (M) gene, complete cds. |
| AY862628 | Influenza A virus (A/dove/Korea/S11/03(H3N2)) matrix protein (M) gene, complete cds. |
| Z26858 | Influenza virus type A M and M2 genes for matrix proteins |
| AB166865 | Influenza A virus (A/chicken/Yamaguchi/7/2004(H5N1)) M1 and M2 genes for matrix protein and membrane ion channel, complete cds. |
| AB188819 | Influenza A virus (A/chicken/Oita/8/2004(H5N1)) M2, M1 genes for membrane ion channel 2, matrix protein 1, complete cds. |
| AF509043 | Influenza A virus (A/Chicken/Hong Kong/FY150/01 (H5N1)) M1 protein (M1) gene, complete cds. |
| AF509044 | Influenza A virus (A/Pheasant/Hong Kong/FY155/01 (H5N1)) M1 protein (M1) gene, complete cds. |
| AF509045 | Influenza A virus (A/Silky Chicken/Hong Kong/SF189/01 (H5N1)) M1 protein (M1) gene, complete cds. |
| AF509046 | Influenza A virus (A/Quail/Hong Kong/SF203/01 (H5N1)) M1 protein (M1) gene, complete cds. |
| AF509047 | Influenza A virus (A/Pigeon/Hong Kong/SF215/01 (H5N1)) M1 protein (M1) gene, complete cds. |
| AF509048 | Influenza A virus (A/Chicken/Hong Kong/SF219/01 (H5N1)) M1 protein (M1) gene, complete cds. |
| AF509049 | Influenza A virus (A/Chicken/Hong Kong/715.5/01 (H5N1)) M1 protein (M1) gene, complete cds. |
| AF509050 | Influenza A virus (A/Chicken/Hong Kong/751.1/01 (H5N1)) M1 protein (M1) gene, complete cds. |
| AF509051 | Influenza A virus (A/Chicken/Hong Kong/822.1/01 (H5N1)) M1 protein (M1) gene, complete cds. |
| AF509052 | Influenza A virus (A/Chicken/Hong Kong/829.2/01 (H5N1)) M1 protein (M1) gene, complete cds. |
| AF509053 | Influenza A virus (A/Chicken/Hong Kong/830.2/01 (H5N1)) M1 protein (M1) gene, complete cds. |
| AF509054 | Influenza A virus (A/Chicken/Hong Kong/858.3/01 (H5N1)) M1 protein (M1) gene, complete cds. |
| AF509055 | Influenza A virus (A/Chicken/Hong Kong/866.3/01 (H5N1)) M1 protein (M1) gene, complete cds. |
| AF509056 | Influenza A virus (A/Chicken/Hong Kong/867.1/01 (H5N1)) M1 protein (M1) gene, complete cds. |
| AF509057 | Influenza A virus (A/Chicken/Hong Kong/879.1/01 (H5N1)) M1 protein (M1) gene, complete cds. |
| AF509058 | Influenza A virus (A/Chicken/Hong Kong/873.3/01 (H5N1)) M1 protein (M1) gene, complete cds. |
| AF509059 | Influenza A virus (A/Chicken/Hong Kong/876.1/01 (H5N1)) M1 protein (M1) gene, complete cds. |
| AF509060 | Influenza A virus (A/Chicken/Hong Kong/891.1/01 (H5N1)) M1 protein (M1) gene, complete cds. |
| AF509061 | Influenza A virus (A/Chicken/Hong Kong/893.2/01 (H5N1)) M1 protein (M1) gene, complete cds. |
| AF509062 | Influenza A virus (A/Goose/Hong Kong/76.1/01 (H5N1)) M1 protein (M1) gene, complete cds. |
| AF509063 | Influenza A virus (A/Goose/Hong Kong/ww100/01 (H5N1)) M1 protein (M1) gene, complete cds. |
| AF509064 | Influenza A virus (A/Duck/Hong Kong/573.4/01 (H5N1)) M1 protein (M1) gene, complete cds. |
| AF509065 | Influenza A virus (A/Duck/Hong Kong/646.3/01 (H5N1)) M1 protein (M1) gene, complete cds. |
| AY059506 | Influenza A virus (A/Goose/Hong Kong/ww26/2000(H5N1)) segment 7 matrix protein (M) gene, partial cds. |
| AY059507 | Influenza A virus (A/Goose/Hong Kong/ww28/2000(H5N1)) segment 7 matrix protein (M) gene, partial cds. |
| AY059508 | Influenza A virus (A/Duck/Hong Kong/ww381/2000(H5N1)) segment 7 matrix protein (M) gene, partial cds. |
| AY059509 | Influenza A virus (A/Duck/Hong Kong/ww461/2000(H5N1)) segment 7 matrix protein (M) gene, partial cds. |
| AY059510 | Influenza A virus (A/Goose/Hong Kong/ww491/2000(H5N1)) segment 7 matrix protein (M) gene, partial cds. |

TABLE 6-continued

| | |
|---|---|
| AY059511 | Influenza A virus (A/Duck/Hong Kong/2986.1/2000(H5N1)) segment 7 matrix protein (M) gene, partial cds. |
| AY059512 | Influenza A virus (A/Goose/Hong Kong/3014.8/2000(H5N1)) segment 7 matrix protein (M) gene, partial cds. |
| AY075029 | Influenza A virus (A/Chicken/Hong Kong/317.5/2001(H5N1)) matrix protein 1 and matrix protein 2 (M) gene, complete cds. |
| AY075035 | Influenza A virus (A/Duck/Hong Kong/380.5/2001(H5N1)) matrix protein 1 and matrix protein 2 (M) gene, complete cds. |
| AY221530 | Influenza A virus (A/Chicken/HongKong/NT873.3/01-MB(H5N1)) matrix protein (M) gene, complete cds. |
| AY221531 | Influenza A virus (A/Chicken/HongKong/NT873.3/01(H5N1)) matrix protein (M) gene, complete cds. |
| AY221532 | Influenza A virus (A/Chicken/HongKong/FY150/01-MB(H5N1)) matrix protein (M) gene, complete cds. |
| AY221533 | Influenza A virus (A/Chicken/HongKong/FY150/01(H5N1)) matrix protein (M) gene, complete cds. |
| AY221534 | Influenza A virus (A/Pheasant/HongKong/FY155/01-MB(H5N1)) matrix protein (M) gene, complete cds. |
| AY221535 | Influenza A virus (A/Pheasant/HongKong/FY155/01(H5N1)) matrix protein (M) gene, complete cds. |
| AY221536 | Influenza A virus (A/Chicken/HongKong/YU822.2/01-MB(H5N1)) matrix protein (M) gene, complete cds. |
| AY221537 | Influenza A virus (A/Chicken/HongKong/YU822.2/01(H5N1)) matrix protein (M) gene, complete cds. |
| AY221538 | Influenza A virus (A/Chicken/HongKong/YU562/01(H5N1)) matrix protein (M) gene, complete cds. |
| AY518361 | Influenza A virus (A/duck/China/E319-2/03(H5N1)) membrane ion channel M2 and matrix protein M1 (M) gene, complete cds. |
| AY575895 | Influenza A virus (A/Gs/HK/739.2/02 (H5N1)) matrix protein (M) gene, complete cds. |
| AY575896 | Influenza A virus (A/Eg/HK/757.3/02 (H5N1)) matrix protein (M) gene, partial cds. |
| AY575897 | Influenza A virus (A/G.H/HK/793.1/02 (H5N1)) matrix protein (M) gene, partial cds. |
| AY575898 | Influenza A virus (A/Dk/HK/821/02 (H5N1)) matrix protein (M) gene, partial cds. |
| AY575899 | Influenza A virus (A/Ck/HK/31.4/02 (H5N1)) matrix protein (M) gene, complete cds. |
| AY575900 | Influenza A virus (A/Ck/HK/61.9/02 (H5N1)) matrix protein (M) gene, complete cds. |
| AY575901 | Influenza A virus (A/Ck/HK/YU777/02 (H5N1)) matrix protein (M) gene, complete cds. |
| AY575902 | Influenza A virus (A/Ck/HK/96.1/02 (H5N1)) matrix protein (M) gene, complete cds. |
| AY575903 | Influenza A virus (A/Ck/HK/409.1/02 (H5N1)) matrix protein (M) gene, complete cds. |
| AY575904 | Influenza A virus (A/Ph/HK/sv674.15/02 (H5N1)) matrix protein (M) gene, complete cds. |
| AY585378 | Influenza A virus (A/duck/Fujian/01/2002(H5N1)) matrix protein mRNA, complete cds. |
| AY585379 | Influenza A virus (A/duck/Fujian/13/2002(H5N1)) matrix protein mRNA, complete cds. |
| AY585380 | Influenza A virus (A/duck/Fujian/17/2001(H5N1)) matrix protein mRNA, complete cds. |
| AY585381 | Influenza A virus (A/duck/Fujian/19/2000(H5N1)) matrix protein mRNA, complete cds. |
| AY585382 | Influenza A virus (A/duck/Guangdong/01/2001(H5N1)) matrix protein mRNA, complete cds. |
| AY585383 | Influenza A virus (A/duck/Guangdong/07/2000(H5N1)) matrix protein mRNA, complete cds. |
| AY585384 | Influenza A virus (A/duck/Guangdong/12/2000(H5N1)) matrix protein mRNA, complete cds. |
| AY585385 | Influenza A virus (A/duck/Guangdong/22/2002(H5N1)) matrix protein mRNA, complete cds. |
| AY585386 | Influenza A virus (A/duck/Guangdong/40/2000(H5N1)) matrix protein mRNA, complete cds. |
| AY585387 | Influenza A virus (A/duck/Guangxi/07/1999(H5N1)) matrix protein mRNA, complete cds. |
| AY585388 | Influenza A virus (A/duck/Guangxi/22/2001(H5N1)) matrix protein mRNA, partial cds. |
| AY585389 | Influenza A virus (A/duck/Guangxi/35/2001(H5N1)) matrix protein mRNA, complete cds. |
| AY585390 | Influenza A virus (A/duck/Guangxi/53/2002(H5N1)) matrix protein mRNA, complete cds. |
| AY585391 | Influenza A virus (A/duck/Shanghai/08/2001(H5N1)) matrix protein mRNA, complete cds. |
| AY585392 | Influenza A virus (A/duck/Shanghai/13/2001(H5N1)) matrix protein mRNA, complete cds. |
| AY585393 | Influenza A virus (A/duck/Shanghai/35/2002(H5N1)) matrix protein mRNA, complete cds. |

TABLE 6-continued

| | |
|---|---|
| AY585394 | Influenza A virus (A/duck/Shanghai/37/2002(H5N1)) matrix protein mRNA, complete cds. |
| AY585395 | Influenza A virus (A/duck/Shanghai/38/2001(H5N1)) matrix protein mRNA, complete cds. |
| AY585396 | Influenza A virus (A/duck/Zhejiang/11/2000(H5N1)) matrix protein mRNA, complete cds. |
| AY585397 | Influenza A virus (A/duck/Zhejiang/52/2000(H5N1)) matrix protein mRNA, complete cds. |
| AY585398 | Influenza A virus (A/duck/Guangxi/50/2001(H5N1)) matrix protein mRNA, complete cds. |
| AY590578 | Influenza A virus (A/chicken/Nakorn-Patom/Thailand/CU-K2/2004(H5N1)) matrix protein M2 and matrix protein M1 (M) gene, partial and complete cds. |
| AY609315 | Influenza A virus (A/chicken/Guangdong/174/04(H5N1)) segment 7, complete sequence. |
| AY651374 | Influenza A virus (A/Ck/Indonesia/BL/2003(H5N1)) membrane ion channel 2 (M) gene, partial cds; and matrix protein 1 (M) gene, complete cds. |
| AY651375 | Influenza A virus (A/Dk/Indonesia/MS/2004(H5N1)) membrane ion channel 2 and matrix protein 1 (M) gene, complete cds. |
| AY651376 | Influenza A virus (A/Ck/Indonesia/PA/2003(H5N1)) membrane ion channel 2 and matrix protein 1 (M) gene, complete cds. |
| AY651377 | Influenza A virus (A/Ck/Indonesia/2A/2003(H5N1)) membrane ion channel 2 and matrix protein 1 (M) gene, complete cds. |
| AY651378 | Influenza A virus (A/Ck/Indonesia/4/2004(H5N1)) membrane ion channel 2 and matrix protein 1 (M) gene, complete cds. |
| AY651379 | Influenza A virus (A/Ck/Indonesia/5/2004(H5N1)) membrane ion channel 2 and matrix protein 1 (M) gene, complete cds. |
| AY651380 | Influenza A virus (A/Ck/Thailand/1/2004(H5N1)) membrane ion channel 2 and matrix protein 1 (M) gene, complete cds. |
| AY651381 | Influenza A virus (A/Ck/Thailand/73/2004(H5N1)) membrane ion channel 2 (M) gene, partial cds; and matrix protein 1 (M) gene, complete cds. |
| AY651382 | Influenza A virus (A/Ck/Thailand/9.1/2004(H5N1)) membrane ion channel 2 (M) gene, partial cds; and matrix protein 1 (M) gene, complete cds. |
| AY651383 | Influenza A virus (A/Qa/Thailand/57/2004(H5N1)) membrane ion channel 2 and matrix protein 1 (M) gene, complete cds. |
| AY651384 | Influenza A virus (A/bird/Thailand/3.1/2004(H5N1)) membrane ion channel 2 (M) gene, partial cds; and matrix protein 1 (M) gene, complete cds. |
| AY651385 | Influenza A virus (A/Dk/Thailand/71.1/2004(H5N1)) membrane ion channel 2 (M) gene, partial cds; and matrix protein 1 (M) gene, complete cds. |
| AY651386 | Influenza A virus (A/Gs/Thailand/79/2004(H5N1)) membrane ion channel 2 (M) gene, partial cds; and matrix protein 1 (M) gene, complete cds. |
| AY651391 | Influenza A virus (A/Ck/Viet Nam/33/2004(H5N1)) membrane ion channel 2 and matrix protein 1 (M) gene, complete cds. |
| AY651392 | Influenza A virus (A/Ck/Viet Nam/35/2004(H5N1)) membrane ion channel 2 and matrix protein 1 (M) gene, complete cds. |
| AY651393 | Influenza A virus (A/Ck/Viet Nam/36/2004(H5N1)) membrane ion channel 2 (M) gene, partial cds; and matrix protein 1 (M) gene, complete cds. |
| AY651394 | Influenza A virus (A/Ck/Viet Nam/37/2004(H5N1)) membrane ion channel 2 and matrix protein 1 (M) gene, complete cds. |
| AY651395 | Influenza A virus (A/Ck/Viet Nam/38/2004(H5N1)) membrane ion channel 2 and matrix protein 1 (M) gene, complete cds. |
| AY651396 | Influenza A virus (A/Ck/Viet Nam/39/2004(H5N1)) membrane ion channel 2 (M) gene, partial cds; and matrix protein 1 (M) gene, complete cds. |
| AY651397 | Influenza A virus (A/Ck/Viet Nam/C57/2004(H5N1)) membrane ion channel 2 (M) gene, partial cds; and matrix protein 1 (M) gene, complete cds. |
| AY651398 | Influenza A virus (A/Dk/Viet Nam/11/2004(H5N1)) membrane ion channel 2 and matrix protein 1 (M) gene, complete cds. |
| AY651399 | Influenza A virus (A/Gf/HK/38/2002(H5N1)) membrane ion channel 2 and matrix protein 1 (M) gene, partial cds. |
| AY651400 | Influenza A virus (A/Ck/HK/31.2/2002(H5N1)) membrane ion channel 2 and matrix protein 1 (M) gene, complete cds. |
| AY651401 | Influenza A virus (A/Ck/HK/37.4/2002(H5N1)) membrane ion channel 2 and matrix protein 1 (M) gene, complete cds. |
| AY651402 | Influenza A virus (A/SCk/HK/YU100/2002(H5N1)) membrane ion channel 2 and matrix protein 1 (M) gene, complete cds. |
| AY651403 | Influenza A virus (A/Ck/HK/YU22/2002(H5N1)) membrane ion channel 2 and matrix protein 1 (M) gene, complete cds. |
| AY651404 | Influenza A virus (A/Ck/HK/3176.3/2002(H5N1)) membrane ion channel 2 and matrix protein 1 (M) gene, partial cds. |
| AY651405 | Influenza A virus (A/Ck/HK/3169.1/2002(H5N1)) matrix protein 1 and membrane ion channel 2 (M) gene, partial cds. |

TABLE 6-continued

| | |
|---|---|
| AY651406 | Influenza A virus (A/Ck/HK/FY157/2003(H5N1)) membrane ion channel 2 and matrix protein 1 (M) gene, complete cds. |
| AY651407 | Influenza A virus (A/Ck/HK/YU324/2003(H5N1)) membrane ion channel 2 and matrix protein 1 (M) gene, complete cds. |
| AY651408 | Influenza A virus (A/Ck/HK/2133.1/2003(H5N1)) membrane ion channel 2 and matrix protein 1 (M) gene, partial cds. |
| AY651409 | Influenza A virus (A/Ck/HK/NT93/2003(H5N1)) membrane ion channel 2 (M) gene, partial cds; and matrix protein 1 (M) gene, complete cds. |
| AY651410 | Influenza A virus (A/Ck/HK/SSP141/2003(H5N1)) membrane ion channel 2 (M) gene, partial cds; and matrix protein 1 (M) gene, complete cds. |
| AY651411 | Influenza A virus (A/Ck/HK/WF157/2003(H5N1)) membrane ion channel 2 and matrix protein 1 (M) gene, complete cds. |
| AY651412 | Influenza A virus (A/peregrine falcon/HK/D0028/2004(H5N1)) membrane ion channel 2 (M) gene, partial cds; and matrix protein 1 (M) gene, complete cds. |
| AY651413 | Influenza A virus (A/black headed gull/HK/12.1/2003(H5N1)) membrane ion channel 2 and matrix protein 1 (M) gene, complete cds. |
| AY651414 | Influenza A virus (A/grey heron/HK/861.1/2002(H5N1)) membrane ion channel 2 and matrix protein 1 (M) gene, complete cds. |
| AY651415 | Influenza A virus (A/feral pigeon/HK/862.7/2002(H5N1)) membrane ion channel 2 and matrix protein 1 (M) gene, complete cds. |
| AY651416 | Influenza A virus (A/tree sparrow/HK/864/2002(H5N1)) matrix protein 1 and membrane ion channel 2 (M) gene, partial cds. |
| AY651417 | Influenza A virus (A/teal/China/2978.1/2002(H5N1)) membrane ion channel 2 and matrix protein 1 (M) gene, partial cds. |
| AY651418 | Influenza A virus (A/Dk/HN/5806/2003(H5N1)) membrane ion channel 2 (M) gene, partial cds; and matrix protein 1 (M) gene, complete cds. |
| AY651419 | Influenza A virus (A/Dk/ST/4003/2003(H5N1)) membrane ion channel 2 (M) gene, partial cds; and matrix protein 1 (M) gene, complete cds. |
| AY651420 | Influenza A virus (A/Ck/ST/4231/2003(H5N1)) membrane ion channel 2 (M) gene, partial cds; and matrix protein 1 (M) gene, complete cds. |
| AY651421 | Influenza A virus (A/Dk/YN/6255/2003(H5N1)) membrane ion channel 2 (M) gene, partial cds; and matrix protein 1 (M) gene, complete cds. |
| AY651422 | Influenza A virus (A/Dk/YN/6445/2003(H5N1)) membrane ion channel 2 (M) gene, partial cds; and matrix protein 1 (M) gene, complete cds. |
| AY651423 | Influenza A virus (A/Ck/YN/374/2004(H5N1)) membrane ion channel 2 (M) gene, partial cds; and matrix protein 1 (M) gene, complete cds. |
| AY651424 | Influenza A virus (A/Dk/HN/101/2004(H5N1)) membrane ion channel 2 (M) gene, partial cds; and matrix protein 1 (M) gene, complete cds. |
| AY651425 | Influenza A virus (A/Dk/HN/303/2004(H5N1)) membrane ion channel 2 (M) gene, partial cds; and matrix protein 1 (M) gene, complete cds. |
| AY651426 | Influenza A virus (A/Ph/ST/44/2004(H5N1)) membrane ion channel 2 (M) gene, partial cds; and matrix protein 1 (M) gene, complete cds. |
| AY651427 | Influenza A virus (A/Ck/YN/115/2004(H5N1)) membrane ion channel 2 (M) gene, partial cds; and matrix protein 1 (M) gene, complete cds. |
| AY653194 | Influenza A virus (A/chicken/Jilin/9/2004(H5N1)) segment 7, complete sequence. |
| AY676045 | Influenza A virus strain (A/duck/Hong Kong/821/02(H5N1)) membrane protein (M) gene, complete cds. |
| AY676046 | Influenza A virus strain (A/egret/Hong Kong/757.2/03(H5N1)) membrane protein (M) gene, complete cds. |
| AY676047 | Influenza A virus strain (A/chicken/Korea/ES/03(H5N1)) membrane protein (M) gene, complete cds. |
| AY676048 | Influenza A virus strain (A/duck/Korea/ESD1/03(H5N1)) membrane protein (M) gene, complete cds. |
| AY684709 | Influenza A virus (A/chicken/Hubei/327/2004(H5N1)) matrix protein 2 (M2) and matrix protein 1 (M1) genes, complete cds. |
| AY737292 | Influenza A virus (A/chicken/Guangdong/191/04(H5N1)) segment 7, complete sequence. |
| AY737298 | Influenza A virus (A/chicken/Guangdong/178/04(H5N1)) segment 7, complete sequence. |
| AY737306 | Influenza A virus (A/duck/Guangdong/173/04(H5N1)) segment 7, complete sequence. |
| AY770077 | Influenza A virus (A/chicken/Hubei/489/2004(H5N1)) matrix protein 2 (M2) and matrix protein 1 (M1) genes, complete cds. |
| AY770998 | Influenza A virus (A/chicken/Ayutthaya/Thailand/CU-23/04(H5N1)) matrix protein gene, complete cds. |
| AY818145 | Influenza A virus (A/chicken/Vietnam/C58/04(H5N1)) matrix protein M1 gene, complete cds. |

TABLE 6-continued

| | |
|---|---|
| AY818146 | Influenza A virus (A/quail/Vietnam/36/04(H5N1)) matrix protein M1 gene, complete cds. |
| AY856865 | Influenza A virus (A/duck/Shandong/093/2004(H5N1)) segment 7, complete sequence. |
| DQ055851 | Influenza A virus (A/chicken/Yunnan/K001/2004(H5N1)) matrix protein M1 gene, complete cds. |
| AB189048 | Influenza A virus (A/chicken/Kyoto/3/2004(H5N1)) M2, M1 genes for membrane ion channel; M2, matrix protein 1, complete cds,. |
| AB189056 | Influenza A virus (A/crow/Kyoto/53/2004(H5N1)) M2, M1 genes for membrane ion channel; M2, matrix protein 1, complete cds,. |
| AB189064 | Influenza A virus (A/crow/Osaka/102/2004(H5N1)) M2, M1 genes for membrane ion channel; M2, matrix protein 1, complete cds,. |
| AF046082 | Influenza A virus (A/Chicken/Hong Kong/220/97 (H5N1)) matrix protein 2 (M2) and matrix protein 1 (M1) genes, complete cds. |
| AF098560 | Influenza A virus (A/Chicken/Hong Kong/258/97 (H5N1)) M1 matrix protein (M) and M2 matrix protein (M) genes, partial cds. |
| AF098561 | Influenza A virus (A/Chicken/Hong Kong/y388/97 (H5N1)) M1 matrix protein (M) and M2 matrix protein (M) genes, partial cds. |
| AF098562 | Influenza A virus (A/Chicken/Hong Kong/728/97 (H5N1)) M1 matrix protein (M) and M2 matrix protein (M) genes, partial cds. |
| AF098563 | Influenza A virus (A/Chicken/Hong Kong/786/97 (H5N1)) M1 matrix protein (M) and M2 matrix protein (M) genes, partial cds. |
| AF098564 | Influenza A virus (A/Chicken/Hong Kong/915/97 (H5N1)) M1 matrix protein (M) and M2 matrix protein (M) genes, partial cds. |
| AF098566 | Influenza A virus (A/Duck/Hong Kong/p46/97 (H5N1)) M1 matrix protein (M) and M2 matrix protein (M) genes, partial cds. |
| AF098567 | Influenza A virus (A/Duck/Hong Kong/y283/97 (H5N1)) M1 matrix protein (M) and M2 matrix protein (M) genes, partial cds. |
| AF098568 | Influenza A virus (A/Goose/Hong Kong/w355/97 (H5N1)) M1 matrix protein (M) and M2 matrix protein (M) genes, partial cds. |
| AF144306 | Influenza A virus (A/Goose/Guangdong/1/96(H5N1)) matrix proteins M1 and M2 (M) gene, alternatively spliced products, complete cds. |
| AF216711 | Influenza A virus (A/Environment/Hong Kong/437-4/99 (H5N1)) matrix protein 1 and matrix protein 2 genes, complete cds. |
| AF216719 | Influenza A virus (A/Environment/Hong Kong/437-6/99 (H5N1)) matrix protein 1 and matrix protein genes, complete cds. |
| AF216727 | Influenza A virus (A/Environment/Hong Kong/437-8/99 (H5N1)) matrix protein 1 and matrix protein 2 genes, complete cds. |
| AF216735 | Influenza A virus (A/Environment/Hong Kong/437-10/99 (H5N1)) matrix protein 1 and matrix protein 2 genes, complete cds. |
| AF359560 | Influenza A virus (A/Goose/Guangdong/3/97(H5N1)) matrix protein 1 and matrix protein 2 (M) gene, complete cds. |
| AF398429 | Influenza A virus (A/Goose/Hong Kong/385.3/2000(H5N1)) matrix protein 1 (M) gene, partial cds. |
| AF398430 | Influenza A virus (A/Goose/Hong Kong/385.5/2000(H5N1)) matrix protein 1 (M) gene, partial cds. |
| AF468843 | Influenza A virus (A/Duck/Anyang/AVL-1/2001(H5N1)) matrix protein 1 and matrix protein 2 genes, complete cds. |
| AF509040 | Influenza A virus (A/Chicken/Hong Kong/FY77/01 (H5N1)) M1 protein (M1) gene, complete cds. |
| AF509041 | Influenza A virus (A/Chicken/Hong Kong/YU562/01 (H5N1)) M1 protein (M1) gene, complete cds. |
| AF509042 | Influenza A virus (A/Chicken/Hong Kong/YU563/01 (H5N1)) M1 protein (M1) gene, complete cds. |
| AF073180 | Influenza A virus (A/Chicken/New Jersey/15086-3/94 (H7N3NSA)) matrix protein 1 (M1) and matrix protein 2 (M2) genes, complete cds. |
| AF073197 | Influenza A virus (A/Turkey/Oregon/71 (H7N3NSB)) matrix protein 1 (M1) and matrix protein 2 (M2) genes, complete cds. |
| AY664433 | Influenza A Virus (A/ruddy turnstone/New Jersey/65/85(H7N3)) nonfunctional matrix protein mRNA, partial sequence. |
| AY677732 | Influenza A virus (A/chicken/British Columbia/CN7-3/04 (H7N3)) matrix protein 1 (M1) gene, complete cds. |
| AF073198 | Influenza A virus (A/Turkey/Colorado/13356/91 (H7N3NSA)) matrix protein 1 (M1) and matrix protein 2 (M2) genes, complete cds. |
| AF073200 | Influenza A virus (A/Quail/Arkansas/16309-7/94(H7N3NSA)) matrix protein 1 (M1) and matrix protein 2 (M2) genes, complete cds. |
| AF073201 | Influenza A virus (A/Turkey/Utah/24721-10/95 (H7N3NSA)) matrix protein 1 (M1) and matrix protein 2 (M2) genes, complete cds. |
| AJ627492 | Influenza A virus (A/turkey/Italy/214845/2002(H7N3)) gene for membrane protein 1 and gene for membrane protein 2, genomic RNA. |
| AJ627497 | Influenza A virus (A/turkey/Italy/220158/2002(H7N3)) gene for membrane protein 1 and gene for membrane protein 2, genomic RNA. |
| AY241600 | Influenza A virus (A/Chicken/New York/12273-11/99(H7N3)) matrix protein 1 and matrix protein 2 genes, complete cds. |
| AY241602 | Influenza A virus (A/chicken/NY/14714-9/99(H7N3)) matrix protein 1 and matrix protein 2 genes, complete cds. |
| AY241615 | Influenza A virus (A/Duck/NJ/117228-7/01(H7N3)) matrix protein 1 and matrix protein 2 genes, complete cds. |
| AY241616 | Influenza A virus (A/Duck/PA/143585/01(H7N3)) matrix protein 1 and matrix protein 2 genes, complete cds. |

TABLE 6-continued

| | |
|---|---|
| AY300975 | Influenza A virus (A/Blue-winged Teal/TX/2/01 (H7N3) membrane protein (M) gene, complete cds. |
| AY303652 | Influenza A virus (A/chicken/Chile/176822/02(H7N3)) matrix protein 1 and matrix protein 2 genes, complete cds. |
| AY303653 | Influenza A virus (A/chicken/Chile/4322/02(H7N3)) matrix protein 1 and matrix protein 2 genes, complete cds. |
| AY303654 | Influenza A virus (A/chicken/Chile/4957/02(H7N3)) matrix protein 1 gene, complete cds; and matrix protein 2 gene, partial cds. |
| AY303655 | Influenza A virus (A/chicken/Chile/4968/02(H7N3)) matrix protein 1 and matrix protein 2 genes, complete cds. |
| AY303656 | Influenza A virus (A/chicken/Chile/4977/02(H7N3)) matrix protein 1 and matrix protein 2 genes, complete cds. |
| AY303657 | Influenza A virus (A/turkey/Chile/4418/02(H7N3)) matrix protein 1 gene, complete cds; and matrix protein 2 gene, partial cds. |
| AY586427 | Influenza A Virus (A/turkey/Italy/214845/02(H7N3)) matrix protein gene, partial cds. |
| AY586428 | Influenza A virus (A/turkey/Italy/220158/2002(H7N3)) matrix protein gene, partial cds. |
| AY586429 | Influenza A Virus (A/mallard/Italy/43/01(H7N3)) matrix protein gene, partial cds. |
| AY586430 | Influenza A virus (A/mallard/Italy/33/01(H7N3)) matrix protein gene, partial cds. |
| AY611525 | Influenza A virus (A/chicken/British Columbia/04(H7N3)) matrix protein 2 (M) and matrix protein 1 (M) genes, complete cds. |
| AY646079 | Influenza A virus (A/chicken/British Columbia/GSC_human_B/04(H7N3)) matrix protein 2 and matrix protein 1 (M) gene, complete cds. |
| AY648288 | Influenza A virus (A/GSC_chicken_B/British Columbia/04(H7N3)) matrix protein 2 (M) and matrix protein 1 (M) genes, complete cds. |
| AY650271 | Influenza A virus (A/GSC_chicken/British Columbia/04(H7N3)) matrix protein 2 (M) and matrix protein 1 (M) genes, complete cds. |
| AJ619676 | Influenza A virus (A/chicken/Germany/R28/03(H7N7)) M1 gene for membrane protein 1, genomic RNA. |
| AY340086 | Influenza A virus (A/Netherlands/124/03(H7N7)) matrix protein gene, partial cds. |
| AY340087 | Influenza A virus (A/Netherlands/126/03(H7N7)) matrix protein gene, partial cds. |
| AY340088 | Influenza A virus (A/Netherlands/127/03(H7N7)) matrix protein gene, partial cds. |
| AY340089 | Influenza A virus (A/Netherlands/219/03(H7N7)) matrix protein gene, complete cds. |
| AY340090 | Influenza A virus (A/Netherlands/33/03(H7N7)) matrix protein gene, complete cds. |
| AY340091 | Influenza A virus (A/chicken/Netherlands/1/03(H7N7)) matrix protein gene, complete cds. |
| AY664468 | Influenza A virus (A/ruddy turnstone/Delaware/134/99 (H7N7)) nonfunctional matrix protein mRNA, partial sequence. |
| L37795 | Influenza virus A/chicken/Brescia/1902 (H7N7) matrix protein (M1) gene and transmembrane protein (M2) gene, complete cds. |
| L37796 | Influenza virus A/FPV/Dobson (H7N7) matrix protein (M1) gene and transmembrane protein (M2) gene, complete cds. |
| L37797 | Influenza virus A/FPV/Weybridge (H7N7) matrix protein (M1) gene and transmembrane protein (M2) gene, complete cds. |
| M23917 | Influenza A/chicken/FPV/Weybridge (H7N7) M1 matrix protein gene, complete cds. |
| M23921 | Influenza A/chicken/FPV/Weybridge (H7N7) M2 matrix protein gene, complete cds. |
| M38299 | Influenza A/FPV/Weybridge (H7N7) matrix (M) protein (seg 7) gene, complete cds. |
| M63523 | Influenza A virus (A/chicken/Victoria/1/85 (H7N7)) membrane protein M1 and membrane protein M2 genes, complete cds. |
| M63526 | Influenza virus type A (strain A/FPV/Dobson/27 (H7N7)) membrane protein M1 and membrane protein M2 genes, complete cds. |
| AB049165 | Influenza A virus (A/parakeet/Chiba/1/97(H9N2)) M1, M2 genes for membrane ion channel, matrix protein, complete cds. |
| AB049166 | Influenza A virus (A/parakeet/Narita/92A/98(H9N2)) M1, M2 genes for membrane ion channel, matrix protein, complete cds. |
| AF222671 | Influenza A virus (A/Silky Chicken/Hong Kong/SF44/99(H9N2)) segment 7 M1 (M1) gene, partial cds. |
| AF508684 | Influenza A virus (A/Ostrich/South Africa/9508103/95(H9N2)) segment 7 matrix protein M1 (M) gene, complete cds. |
| AF508685 | Influenza A virus (A/Chicken/Pakistan/4/99(H9N2)) segment 7 matrix protein M1 (M) gene, partial cds. |
| AF508686 | Influenza A virus (A/Chicken/Pakistan/5/99(H9N2)) segment 7 matrix protein M1 (M) gene, partial cds. |
| AF508687 | Influenza A virus (A/Chicken/Germany/R45/98(H9N2)) segment 7 matrix protein M1 (M) gene, complete cds. |
| AF508688 | Influenza A virus (A/Duck/Germany/113/95(H9N2)) segment 7 matrix protein M1 (M) gene, complete cds. |

TABLE 6-continued

| | |
|---|---|
| AF508689 | Influenza A virus (A/Chicken/Iran/11T/99(H9N2)) segment 7 matrix protein M1 (M) gene, partial cds. |
| AF508690 | Influenza A virus (A/Chicken/Saudi Arabia/532/99(H9N2)) segment 7 matrix protein M1 (M) gene, partial cds. |
| AF508691 | Influenza A virus (A/Pheasant/Ireland/PV18/97(H9N2)) segment 7 matrix protein M1 (M) gene, complete cds. |
| AF508692 | Influenza A virus (A/Chicken/Korea/99029/99(H9N2)) segment 7 matrix protein M1 (M) gene, complete cds. |
| AF508693 | Influenza A virus (A/Chicken/Beijing/8/98(H9N2)) segment 7 matrix protein M1 (M) gene, complete cds. |
| AF508694 | Influenza A virus (A/Chicken/Guangdong/10/00(H9N2)) segment 7 matrix protein M1 (M) gene, complete cds. |
| AF508695 | Influenza A virus (A/Chicken/Guangdong/11/97(H9N2)) segment 7 matrix protein M1 (M) gene, complete cds. |
| AF508696 | Influenza A virus (A/Chicken/Heilongjiang/10/97(H9N2)) segment 7 matrix protein M1 (M) gene, complete cds. |
| AF508697 | Influenza A virus (A/Chicken/Henan/62/00(H9N2)) segment 7 matrix protein M1 (M) gene, complete cds. |
| AF508698 | Influenza A virus (A/Chicken/Ningxia/5/99(H9N2)) segment 7 matrix protein M1 (M) gene, complete cds. |
| AF508699 | Influenza A virus (A/Chicken/Sichuan/5/97(H9N2)) segment 7 matrix protein M1 (M) gene, partial cds. |
| AF508700 | Influenza A virus (A/Chicken/Shandong/6/96(H9N2)) segment 7 matrix protein M1 (M) gene, complete cds. |
| AF508701 | Influenza A virus (A/Chicken/Shijiazhuang/2/99(H9N2)) segment 7 matrix protein M1 (M) gene, partial cds. |
| AF508702 | Influenza A virus (A/Chicken/Shenzhen/9/97(H9N2)) segment 7 matrix protein M1 (M) gene, complete cds. |
| AF508703 | Influenza A virus (A/Duck/Nanjing/1/97(H9N2)) segment 7 matrix protein M1 (M) gene, complete cds. |
| AF508704 | Influenza A virus (A/Quail/Shanghai/8/96(H9N2)) segment 7 matrix protein M1 (M) gene, complete cds. |
| AF523482 | Influenza A virus (A/Duck/Shantou/1043/00(H9N2)) matrix protein (M) gene, complete cds. |
| AF523483 | Influenza A virus (A/Duck/Shantou/2134/00(H9N2)) matrix protein (M) gene, complete cds. |
| AF523484 | Influenza A virus (A/Wild Duck/Shantou/4808/01(H9N2)) matrix protein (M) gene, complete cds. |
| AF523485 | Influenza A virus (A/Duck/Shantou/1042/00(H9N2)) matrix protein (M) gene, complete cds. |
| AF523486 | Influenza A virus (A/Duck/Shantou/2143/00(H9N2)) matrix protein (M) gene, complete cds. |
| AF523487 | Influenza A virus (A/Duck/Shantou/2144/00(H9N2)) matrix protein (M) gene, complete cds. |
| AF523488 | Influenza A virus (A/Duck/Shantou/1881/00(H9N2)) matrix protein (M) gene, complete cds. |
| AF523489 | Influenza A virus (A/Duck/Shantou/1796/00(H9N2)) matrix protein (M) gene, complete cds. |
| AF523490 | Influenza A virus (A/Duck/Shantou/2102/00(H9N2)) matrix protein (M) gene, complete cds. |
| AF523491 | Influenza A virus (A/Duck/Shantou/830/00(H9N2)) matrix protein (M) gene, complete cds. |
| AF523492 | Influenza A virus (A/Duck/Shantou/2088/01(H9N2)) matrix protein (M) gene, complete cds. |
| AF523493 | Influenza A virus (A/Duck/Shantou/1605/01(H9N2)) matrix protein (M) gene, complete cds. |
| AF523494 | Influenza A virus (A/Duck/Hong Kong/610/79(H9N2)) matrix protein (M) gene, complete cds. |
| AF523495 | Influenza A virus (A/Duck/Hong Kong/552/79(H9N2)) matrix protein (M) gene, complete cds. |
| AF523496 | Influenza A virus (A/Duck/Hong Kong/289/78(H9N2)) matrix protein (M) gene, complete cds. |
| AF523497 | Influenza A virus (A/Duck/Hong Kong/86/76(H9N2)) matrix protein (M) gene, complete cds. |
| AF523498 | Influenza A virus (A/Duck/Hong Kong/366/78(H9N2)) matrix protein (M) gene, partial cds. |
| AF536719 | Influenza A virus (A/Chicken/Beijing/1/95(H9N2)) nonfunctional matrix protein gene, partial sequence. |
| AF536720 | Influenza A virus (A/Chicken/Beijing/2/97(H9N2)) nonfunctional matrix protein gene, partial sequence. |
| AF536721 | Influenza A virus (A/Chicken/Beijing/3/99(H9N2)) nonfunctional matrix protein gene, partial sequence. |
| AF536722 | Influenza A virus (A/Chicken/Guangdong/97(H9N2)) nonfunctional matrix protein gene, partial sequence. |
| AF536723 | Influenza A virus (A/Chicken/Hebei/1/96(H9N2)) nonfunctional matrix protein gene, partial sequence. |
| AF536724 | Influenza A virus (A/Chicken/Hebei/2/98(H9N2)) nonfunctional matrix protein gene, partial sequence. |
| AF536725 | Influenza A virus (A/Chicken/Hebei/3/98(H9N2)) nonfunctional matrix protein gene, partial sequence. |

TABLE 6-continued

| | |
|---|---|
| AF536726 | Influenza A virus (A/Chicken/Henan/98(H9N2)) nonfunctional matrix protein gene, partial sequence. |
| AF536727 | Influenza A virus (A/Chicken/Liaoning/99(H9N2)) nonfunctional matrix protein gene, partial sequence. |
| AF536728 | Influenza A virus (A/Chicken/Shandong/98(H9N2)) nonfunctional matrix protein gene, partial sequence. |
| AJ291398 | Influenza A virus (A/Chicken/Pakistan/2/99 (H9N2)) M1 gene for Matrix Protein 1 (exon 1) and M2 gene for Matrix Protein 2 (exons 1 and 2), genomic RNA |
| AJ427865 | Influenza A virus (A/quail/Hong Kong/FY298/00 (H9N2)) partial m gene for matrix protein, genomic RNA |
| AY180461 | Influenza A virus strain A/Pigeon/Nanchang/2-0461/2000 (H9N2) matrix protein (M) gene, partial cds. |
| AY180462 | Influenza A virus strain A/Duck/Nanchang/11-290/2000 (H9N2) matrix protein (M) gene, partial cds. |
| AY180463 | Influenza A virus strain A/Duck/Nanchang/11-197/2000 (H9N2) matrix protein (M) gene, partial cds. |
| AY180464 | Influenza A virus strain A/Duck/Nanchang/11-392/2000 (H9N2) matrix protein (M) gene, partial cds. |
| AY180477 | Influenza A virus strain A/Chicken/Nanchang/4-361/2001 (H9N2) matrix protein (M) gene, partial cds. |
| AY180485 | Influenza A virus strain A/Pigeon/Nanchang/11-145/2000 (H9N2) matrix protein (M) gene, partial cds. |
| AY180486 | Influenza A virus strain A/Duck/Nanchang/1-0070/2000 (H9N2) matrix protein (M) gene, partial cds. |
| AY180489 | Influenza A virus strain A/Duck/Nanchang/10-389/2000 (H9N2) matrix protein (M) gene, partial cds. |
| AY180490 | Influenza A virus strain A/Chicken/Nanchang/1-0016/2000 (H9N2) matrix protein (M) gene, partial cds. |
| AY180492 | Influenza A virus strain A/Pigeon/Nanchang/7-058/2000 (H9N2) matrix protein (M) gene, partial cds. |
| AY180495 | Influenza A virus strain A/Quail/Nanchang/2-0460/2000 (H9N2) matrix protein (M) gene, partial cds. |
| AY180502 | Influenza A virus strain A/Chicken/Nanchang/4-010/2000 (H9N2) matrix protein (M) gene, partial cds. |
| AY180504 | Influenza A virus strain A/Quail/Nanchang/4-040/2000 (H9N2) matrix protein (M) gene, partial cds. |
| AY180506 | Influenza A virus strain A/Chicken/Nanchang/4-301/2001 (H9N2) matrix protein (M) gene, partial cds. |
| AY180516 | Influenza A virus strain A/Duck/Nanchang/7-092/2000 (H9N2) matrix protein (M) gene, partial cds. |
| AY180519 | Influenza A virus strain A/Wild Duck/Nanchang/2-0480/2000 (H9N2) matrix protein (M) gene, partial cds. |
| AY253755 | Influenza A virus (A/Chicken/Shanghai/F/98(H9N2)) matrix protein M1 and membrane ion channel M2 genes, complete cds. |
| AY496852 | Influenza A virus (A/chicken/Mudanjiang/0823/2000(H9N2)) matrix protein (M1) mRNA, complete cds. |
| AY633165 | Influenza A virus (A/mallard/Alberta/17/91(H9N2)) matrix protein (M) gene, complete cds. |
| AY633277 | Influenza A virus (A/mallard/Alberta/321/88(H9N2)) matrix protein (M) gene, complete cds. |
| AY633293 | Influenza A virus (A/mallard/Alberta/11/91(H9N2)) matrix protein (M) gene, complete cds. |
| AY664464 | Influenza A virus (A/shorebird/Delaware/276/99 (H9N2)) nonfunctional matrix protein mRNA, partial sequence. |
| AY664679 | Influenza A virus (A/chicken/HongKong/CSW153/03(H9N2)) membrane protein M2 (M) gene, partial cds; and membrane protein M1 (M) gene, complete cds. |
| AY664680 | Influenza A virus (A/chicken/HongKong/AP45/03(H9N2)) membrane protein M2 (M) gene, partial cds; and membrane protein M1 (M) gene, complete cds. |
| AY664681 | Influenza A virus (A/chicken/HongKong/BD90/03(H9N2)) membrane protein M2 (M) gene, partial cds; and membrane protein M1 (M) gene, complete cds. |
| AY664682 | Influenza A virus (A/chicken/HongKong/CSW291/03(H9N2)) membrane protein M2 (M) gene, partial cds; and membrane protein M1 (M) gene, complete cds. |
| AY664683 | Influenza A virus (A/chicken/HongKong/CSW304/03(H9N2)) membrane protein M2 (M) and membrane protein M1 (M) genes, partial cds. |
| AY664684 | Influenza A virus (A/chicken/HongKong/FY23/03(H9N2)) membrane protein M2 (M) gene, partial cds; and membrane protein M1 (M) gene, complete cds. |
| AY664685 | Influenza A virus (A/guineafowl/HongKong/NT101/03(H9N2)) membrane protein M2 (M) gene, partial cds; and membrane protein M1 (M) gene, complete cds. |
| AY664686 | Influenza A virus (A/chicken/HongKong/NT142/03(H9N2)) membrane protein M2 (M) gene, partial cds; and membrane protein M1 (M) gene, complete cds. |

TABLE 6-continued

| | |
|---|---|
| AY664687 | Influenza A virus (A/chicken/HongKong/SF1/03(H9N2)) membrane protein M2 (M) gene, partial cds; and membrane protein M1 (M) gene, complete cds. |
| AY664688 | Influenza A virus (A/chicken/HongKong/SSP101/03(H9N2)) membrane protein M2 (M) gene, partial cds; and membrane protein M1 (M) gene, complete cds. |
| AY664689 | Influenza A virus (A/chicken/HongKong/TP38/03(H9N2)) membrane protein M2 (M) gene, partial cds; and membrane protein M1 (M) gene, complete cds. |
| AY664690 | Influenza A virus (A/chicken/HongKong/WF126/03(H9N2)) membrane protein M2 (M) gene, partial cds; and membrane protein M1 (M) gene, complete cds. |
| AY664691 | Influenza A virus (A/pigeon/HongKong/WF53/03(H9N2)) membrane protein M2 (M) gene, partial cds; and membrane protein M1 (M) gene, complete cds. |
| AY664692 | Influenza A virus (A/pheasant/HongKong/WF54/03(H9N2)) membrane protein M2 (M) gene, partial cds; and membrane protein M1 (M) gene, complete cds. |
| AY664693 | Influenza A virus (A/guineafowl/HongKong/NT184/03(H9N2)) membrane protein M2 (M) gene, partial cds; and membrane protein M1 (M) gene, complete cds. |
| AY664694 | Influenza A virus (A/chicken/HongKong/WF120/03(H9N2)) membrane protein M2 (M) and membrane protein M1 (M) genes, partial cds. |
| AY664695 | Influenza A virus (A/chicken/HongKong/NT366/03(H9N2)) membrane protein M2 (M) gene, partial cds; and membrane protein M1 (M) gene, complete cds. |
| AY664696 | Influenza A virus (A/chicken/HongKong/SSP418/03(H9N2)) membrane protein M2 (M) gene, partial cds; and membrane protein M1 (M) gene, complete cds. |
| AY664697 | Influenza A virus (A/chicken/HongKong/YU427/03(H9N2)) membrane protein M2 (M) gene, partial cds; and membrane protein M1 (M) gene, complete cds. |
| AY800234 | Influenza A virus (A/chicken/Korea/S1/2003(H9N2)) matrix protein (M) gene, complete cds. |
| AY862614 | Influenza A virus (A/silky chicken/Korea/S3/03(H9N2)) matrix protein (M) gene, complete cds. |
| AY862615 | Influenza A virus (A/chicken/Korea/S4/03(H9N2)) matrix protein (M) gene, complete cds. |
| AY862616 | Influenza A virus (A/chicken/Korea/S5/03(H9N2)) matrix protein (M) gene, complete cds. |
| AY862617 | Influenza A virus (A/chicken/Korea/S12/03(H9N2)) matrix protein (M) gene, complete cds. |
| AY862618 | Influenza A virus (A/duck/Korea/S13/03(H9N2)) matrix protein (M) gene, complete cds. |
| AY862619 | Influenza A virus (A/dove/Korea/S14/03(H9N2)) matrix protein (M) gene, partial cds. |
| AY862620 | Influenza A virus (A/chicken/Korea/S15/03(H9N2)) matrix protein (M) gene, complete cds. |
| AY862621 | Influenza A virus (A/chicken/Korea/S16/03(H9N2)) matrix protein (M) gene, complete cds. |
| AY862622 | Influenza A virus (A/chicken/Korea/S18/03(H9N2)) matrix protein (M) gene, complete cds. |
| AF156458 | Influenza A virus (A/Chicken/Hong Kong/G9/97(H9N2)) segment 7 matrix protein M1 (M1) and matrix protein M2 (M2) genes, complete cds. |
| AF156459 | Influenza A virus (A/Chicken/Hong Kong/G23/97(H9N2)) segment 7 matrix protein M1 (M1) and matrix protein M2 (M2) genes, complete cds. |
| AF156460 | Influenza A virus (A/Pigeon/Hong Kong/Y233/97(H9N2)) segment 7 matrix protein M1 (M1) and matrix protein M2 (M2) genes, complete cds. |
| AF156461 | Influenza A virus (A/Duck/Hong Kong/Y280/97(H9N2)) segment 7 matrix protein M1 (M1) and matrix protein M2 (M2) genes, complete cds. |
| AF156462 | Influenza A virus (A/Duck/Hong Kong/Y439/97(H9N2)) segment 7 matrix protein M1 (M1) and matrix protein M2 (M2) genes, complete cds. |
| AF156463 | Influenza A virus (A/Quail/Hong Kong/G1/97 (H9N2)) segment 7 matrix protein M1 (M1) gene, complete cds; and matrix protein M2 (M2) gene, partial cds. |
| AF156464 | Influenza A virus (A/Chicken/Hong Kong/739/94(H9N2)) segment 7 matrix protein M1 (M1) gene, complete cds; and matrix protein M2 (M2) gene, partial cds. |
| AF156465 | Influenza A virus (A/Quail/Hong Kong/AF157/92(H9N2)) segment 7 matrix protein M1 (M1) gene, complete cds; and matrix protein M2 (M2) gene, partial cds. |
| AF156466 | Influenza A virus (A/Chicken/Beijing/1/94(H9N2)) segment 7 matrix protein M1 (M1) gene, complete cds; and matrix protein M2 (M2) gene, partial cds. |
| AF156467 | Influenza A virus (A/Chicken/Korea/38349-p96323/96(H9N2)) segment 7 matrix protein M1 (M1) gene, complete cds; and matrix protein M2 (M2) gene, partial cds. |
| AF156468 | Influenza A virus (A/Chicken/Korea/25232-96006/96(H9N2)) segment 7 matrix protein M1 (M1) gene, complete cds; and matrix protein M2 (M2) gene, partial cds. |

TABLE 6-continued

| | |
|---|---|
| AF156469 | Influenza A virus (A/Shorebird/Delaware/9/96(H9N2)) segment 7 matrix protein M1 (M1) gene, complete cds; and matrix protein M2 (M2) gene, partial cds. |
| AF156470 | Influenza A virus (A/Quail/Arkansas/29209-1/93(H9N2)) segment 7 matrix protein M1 (M1) gene, complete cds; and matrix protein M2 (M2) gene, partial cds. |
| AF156471 | Influenza A virus (A/Turkey/California/189/66(H9N2)) segment 7 matrix protein M1 (M1) gene, complete cds; and matrix protein M2 (M2) gene, partial cds. |
| AF203788 | Influenza A virus (A/Chicken/Korea/MS96/96(H9N2)) matrix protein 1 mRNA, complete cds; and matrix protein 2 mRNA, partial cds. |
| AF222662 | Influenza A virus (A/Quail/Hong Kong/A17/99(H9N2)) segment 7 M1 (M1) gene, partial cds. |
| AF222663 | Influenza A virus (A/Pigeon/Hong Kong/FY6/99(H9N2)) segment 7 M1 (M1) gene, partial cds. |
| AF222664 | Influenza A virus (A/Chicken/Hong Kong/NT16/99(H9N2)) segment 7 M1 (M1) gene, partial cds. |
| AF222665 | Influenza A virus (A/Quail/Hong Kong/SSP10/99(H9N2)) segment 7 M1 (M1) gene, partial cds. |
| AF222666 | Influenza A virus (A/Pheasant/Hong Kong/SSP11/99(H9N2)) segment 7 M1 (M1) gene, partial cds. |
| AF222667 | Influenza A virus (A/Chicken/Hong Kong/FY20/99(H9N2)) segment 7 M1 (M1) gene, partial cds. |
| AF222668 | Influenza A virus (A/Chicken/Hong Kong/KC12/99(H9N2)) segment 7 M1 (M1) gene, partial cds. |
| AF222669 | Influenza A virus (A/Quail/Hong Kong/NT28/99(H9N2)) segment 7 M1 (M1) gene, partial cds. |
| AF222670 | Influenza A virus (A/Chicken/Hong Kong/SF2/99(H9N2)) segment 7 M1 (M1) gene, partial cds. |
| Sequences used in analysis of Influenza A Nucleocapsid Protein (NP) | |
| AF156415 | Influenza A virus (A/Turkey/California/189/66(H9N2)) segment 5 nucleoprotein (NP) gene, partial cds. |
| AF523423 | Influenza A virus (A/Duck/Hong Kong/86/76(H9N2)) nucleocapsid protein (NP) gene, complete cds. |
| AF523424 | Influenza A virus (A/Duck/Hong Kong/366/78(H9N2)) nucleocapsid protein (NP) gene, partial cds. |
| AF523421 | Influenza A virus (A/Duck/Hong Kong/289/78(H9N2)) nucleocapsid protein (NP) gene, complete cds. |
| AF523422 | Influenza A virus (A/Duck/Hong Kong/552/79(H9N2)) nucleocapsid protein (NP) gene, partial cds. |
| AY633279 | Influenza A virus (A/mallard/Alberta/321/88(H9N2)) nucleoprotein (NP) gene, complete cds. |
| AY633295 | Influenza A virus (A/mallard/Alberta/11/91(H9N2)) nucleoprotein (NP) gene, partial cds. |
| AY633167 | Influenza A virus (A/mallard/Alberta/17/91(H9N2)) nucleoprotein (NP) gene, complete cds. |
| AF156410 | Influenza A virus (A/Quail/Hong Kong/AF157/92(H9N2)) segment 5 nucleoprotein (NP) gene, complete cds. |
| AF156414 | Influenza A virus (A/Quail/Arkansas/29209-1/93 (H9N2)) segment 5 nucleoprotein (NP) gene, partial cds. |
| AF156408 | Influenza A virus (A/Chicken/Hong Kong/739/94(H9N2)) segment 5 nucleoprotein (NP) gene, complete cds. |
| AF156409 | Influenza A virus (A/Chicken/Beijing/1/94(H9N2)) segment 5 nucleoprotein (NP) gene, complete cds. |
| AF536699 | Influenza A virus (A/Chicken/Beijing/1/95(H9N2)) nucleoprotein (NP) gene, partial cds. |
| AF508596 | Influenza A virus (A/Ostrich/South Africa/9508103/95(H9N2)) segment 5 nucleoprotein (NP) gene, partial cds. |
| AF508600 | Influenza A virus (A/Duck/Germany/113/95(H9N2)) segment 5 nucleoprotein (NP) gene, partial cds. |
| AB020778 | Influenza A virus gene for nucleoprotein, complete cds. |
| AF508613 | Influenza A virus (A/Chicken/Shandong/6/96(H9N2)) segment 5 nucleoprotein (NP) gene, partial cds. |
| AF508617 | Influenza A virus (A/Quail/Shanghai/8/96(H9N2)) segment 5 nucleoprotein (NP) gene, partial cds. |
| AF536703 | Influenza A virus (A/Chicken/Hebei/1/96(H9N2)) nucleoprotein (NP) gene, partial cds. |
| AF156411 | Influenza A virus (A/Chicken/Korea/38349-96323/96 (H9N2)) segment 5 nucleoprotein (NP) gene, complete cds. |
| AF156412 | Influenza A virus (A/Chicken/Korea/25232-96006/96 (H9N2)) segment 5 nucleoprotein (NP) gene, partial cds. |
| M63779 | Influenza A/FPV/Dobson/'Dutch'/27 (H7N7) nucleoprotein mRNA, complete cds. |
| M63784 | Influenza A/Teal/Iceland/29/80 (H7N7) nucleoprotein mRNA, complete cds. |
| AJ620352 | Influenza A virus (A/Chicken/Germany/R28/03(H7N7)) NP gene for nucleoprotein, genomic RNA. |
| AY342425 | Influenza A virus (A/Netherlands/219/03(H7N7)) nucleocapsid protein gene, complete cds. |

TABLE 6-continued

| | |
|---|---|
| AY342426 | Influenza A virus (A/Netherlands/033/03(H7N7)) nucleocapsid protein gene, complete cds. |
| AY342427 | Influenza A virus (A/chicken/Netherlands/1/03(H7N7)) nucleocapsid protein gene, complete cds. |
| AF156413 | Influenza A virus (A/Shorebird/Delaware/9/96 (H9N2)) segment 5 nucleoprotein (NP) gene, partial cds. |
| AF203787 | Influenza A virus (A/Chicken/Korea/MS96/96(H9N2)) nucleoprotein mRNA, complete cds. |
| AF156402 | Influenza A virus (A/Chicken/Hong Kong/G9/97(H9N2)) segment 5 nucleoprotein (NP) gene, complete cds. |
| AF156403 | Influenza A virus (A/Chicken/Hong Kong/G23/97(H9N2)) segment 5 nucleoprotein (NP) gene, complete cds. |
| AF156404 | Influenza A virus (A/Pigeon/Hong Kong/Y233/97(H9N2)) segment 5 nucleoprotein (NP) gene, partial cds. |
| AF156405 | Influenza A virus (A/Duck/Hong Kong/Y280/97(H9N2)) segment 5 nucleoprotein (NP) gene, partial cds. |
| AF156406 | Influenza A virus (A/Duck/Hong Kong/Y439/97(H9N2)) segment 5 nucleoprotein (NP) gene, complete cds. |
| AF156407 | Influenza A virus (A/Quail/Hong Kong/G1/97 (H9N2)) segment 5 nucleoprotein (NP) gene, partial cds. |
| AF508612 | Influenza A virus (A/Chicken/Sichuan/5/97(H9N2)) segment 5 nucleoprotein (NP) gene, partial cds. |
| AF536702 | Influenza A virus (A/Chicken/Guangdong/97(H9N2)) nucleoprotein (NP) gene, partial cds. |
| AF536700 | Influenza A virus (A/Chicken/Beijing/2/97(H9N2)) nucleoprotein (NP) gene, partial cds. |
| AF508615 | Influenza A virus (A/Chicken/Shenzhen/9/97(H9N2)) segment 5 nucleoprotein (NP) gene, partial cds. |
| AF508616 | Influenza A virus (A/Duck/Nanjing/1/97(H9N2)) segment 5 nucleoprotein (NP) gene, partial cds. |
| AB049161 | Influenza A virus (A/parakeet/Chiba/1/97(H9N2)) NP gene for nucleoprotein, complete cds. |
| AF508603 | Influenza A virus (A/Pheasant/Ireland/PV18/97(H9N2)) segment 5 nucleoprotein (NP) gene, partial cds. |
| AF508607 | Influenza A virus (A/Chicken/Guangdong/11/97(H9N2)) segment 5 nucleoprotein (NP) gene, partial cds. |
| AF508609 | Influenza A virus (A/Chicken/Heilongjiang/10/97(H9N2)) segment 5 nucleoprotein (NP) gene, partial cds. |
| AF508608 | Influenza A virus (A/Chicken/Hebei/4/98(H9N2)) segment 5 nucleoprotein (NP) gene, partial cds. |
| AF508605 | Influenza A virus (A/Chicken/Beijing/8/98(H9N2)) segment 5 nucleoprotein (NP) gene, partial cds. |
| AF508599 | Influenza A virus (A/Chicken/Germany/R45/98(H9N2)) segment 5 nucleoprotein (NP) gene, partial cds. |
| AF536708 | Influenza A virus (A/Chicken/Shandong/98(H9N2)) nucleoprotein (NP) gene, partial cds. |
| AY253753 | Influenza A virus (A/Chicken/Shanghai/F/98(H9N2)) nucleoprotein (NP) gene, complete cds. |
| AF536704 | Influenza A virus (A/Chicken/Hebei/2/98(H9N2)) nucleoprotein (NP) gene, partial cds. |
| AF536705 | Influenza A virus (A/Chicken/Hebei/3/98(H9N2)) nucleoprotein (NP) gene, partial cds. |
| AF536706 | Influenza A virus (A/Chicken/Henan/98(H9N2)) nucleoprotein (NP) gene, partial cds. |
| AB049162 | Influenza A virus (A/parakeet/Narita/92A/98(H9N2)) NP gene for nucleoprotein, complete cds. |
| AF186270 | Influenza A virus (A/Quail/Hong Kong/NT28/99(H9N2)) segment 5 nucleoprotein (NP) gene, partial cds. |
| AF186271 | Influenza A virus (A/Silkie Chicken/Hong Kong/SF43/99(H9N2)) segment 5 nucleoprotein (NP) gene, partial cds. |
| AF186272 | Influenza A virus (A/Chicken/Hong Kong/SF2/99(H9N2)) segment 5 nucleoprotein (NP) gene, partial cds. |
| AF222614 | Influenza A virus (A/Quail/Hong Kong/A17/99(H9N2)) segment 5 nucleoprotein (NP) gene, partial cds. |
| AF222615 | Influenza A virus (A/Pigeon/Hong Kong/FY6/99(H9N2)) segment 5 nucleoprotein (NP) gene, partial cds. |
| AF222616 | Influenza A virus (A/Chicken/Hong Kong/NT16/99(H9N2)) segment 5 nucleoprotein (NP) gene, partial cds. |
| AF222617 | Influenza A virus (A/Quail/Hong Kong/SSP10/99(H9N2)) segment 5 nucleoprotein (NP) gene, partial cds. |
| AF222618 | Influenza A virus (A/Pheasant/Hong Kong/SSP11/99(H9N2)) segment 5 nucleoprotein (NP) gene, partial cds. |
| AF536707 | Influenza A virus (A/Chicken/Liaoning/99(H9N2)) nucleoprotein (NP) gene, partial cds. |
| AJ291394 | Influenza A virus (A/Chicken/Pakistan/2/99 (H9N2)) NP gene for Nucleoprotein, genomic RNA. |
| AF536701 | Influenza A virus (A/Chicken/Beijing/3/99(H9N2)) nucleoprotein (NP) gene, partial cds. |
| AF508611 | Influenza A virus (A/Chicken/Ningxia/5/99(H9N2)) segment 5 nucleoprotein (NP) gene, partial cds. |

TABLE 6-continued

| | |
|---|---|
| AF508614 | Influenza A virus (A/Chicken/Shijiazhuang/2/99(H9N2)) segment 5 nucleoprotein (NP) gene, partial cds. |
| AF508604 | Influenza A virus (A/Chicken/Korea/99029/99(H9N2)) segment 5 nucleoprotein (NP) gene, partial cds. |
| AF222619 | Influenza A virus (A/Chicken/Hong Kong/FY20/99(H9N2)) segment 5 nucleoprotein (NP) gene, partial cds. |
| AF222620 | Influenza A virus (A/Chicken/Hong Kong/KC12/99(H9N2)) segment 5 nucleoprotein (NP) gene, partial cds. |
| AF222621 | Influenza A virus (A/Silky Chicken/Hong Kong/SF44/99(H9N2)) segment 5 nucleoprotein (NP) gene, partial cds. |
| AF508601 | Influenza A virus (A/Chicken/Iran/11T/99(H9N2)) segment 5 nucleoprotein (NP) gene, partial cds. |
| AF508602 | Influenza A virus (A/Chicken/Saudi Arabia/532/99(H9N2)) segment 5 nucleoprotein (NP) gene, partial cds. |
| AF508597 | Influenza A virus (A/Chicken/Pakistan/4/99(H9N2)) segment 5 nucleoprotein (NP) gene, partial cds. |
| AF508598 | Influenza A virus (A/Chicken/Pakistan/5/99(H9N2)) segment 5 nucleoprotein (NP) gene, partial cds. |
| AF508606 | Influenza A virus (A/Chicken/Guangdong/10/00(H9N2)) segment 5 nucleoprotein (NP) gene, partial cds. |
| AF508610 | Influenza A virus (A/Chicken/Henan/62/00(H9N2)) segment 5 nucleoprotein (NP) gene, partial cds. |
| AF523410 | Influenza A virus (A/Duck/Shantou/1043/00(H9N2)) nucleocapsid protein (NP) gene, partial cds. |
| AF523411 | Influenza A virus (A/Duck/Shantou/2134/00(H9N2)) nucleocapsid protein (NP) gene, partial cds. |
| AF523413 | Influenza A virus (A/Duck/Shantou/1042/00(H9N2)) nucleocapsid protein (NP) gene, partial cds. |
| AF523415 | Influenza A virus (A/Duck/Shantou/2102/00(H9N2)) nucleocapsid protein (NP) gene, partial cds. |
| AF523416 | Influenza A virus (A/Duck/Shantou/830/00(H9N2)) nucleocapsid protein (NP) gene, partial cds. |
| AF523417 | Influenza A virus (A/Duck/Shantou/2144/00(H9N2)) nucleocapsid protein (NP) gene, partial cds. |
| AF523419 | Influenza A virus (A/Duck/Shantou/2143/00(H9N2)) nucleocapsid protein (NP) gene, partial cds. |
| AF523420 | Influenza A virus (A/Duck/Shantou/1881/00(H9N2)) nucleocapsid protein (NP) gene, partial cds. |
| AJ427864 | Influenza A virus (A/quail/Hong Kong/FY298/00 (H9N2)) partial np gene for nucleoprotein, genomic RNA |
| AY180525 | Influenza A virus (A/Pigeon/Nanchang/2-0461/2000(H9N2)) nucleoprotein (NP) gene, partial cds. |
| AY180534 | Influenza A virus strain A/Duck/Nanchang/7-092/2000 (H9N2) nucleoprotein (NP) gene, partial cds. |
| AY180537 | Influenza A virus strain A/Duck/Nanchang/11-392/2000 (H9N2) nucleoprotein (NP) gene, partial cds. |
| AY180538 | Influenza A virus (A/Pigeon/Nanchang/11-145/2000(H9N2)) nucleoprotein (NP) gene, partial cds. |
| AY180542 | Influenza A virus strain A/Duck/Nanchang/11-197/2000 (H9N2) nucleoprotein (NP) gene, partial cds. |
| AY180544 | Influenza A virus strain A/Duck/Nanchang/11-290/2000 (H9N2) nucleoprotein (NP) gene, partial cds. |
| AY180560 | Influenza A virus (A/Pigeon/Nanchang/7-058/2000(H9N2)) nucleoprotein (NP) gene, partial cds. |
| AY180562 | Influenza A virus strain A/Chicken/Nanchang/4-010/2000 (H9N2) nucleoprotein (NP) gene, partial cds. |
| AY180563 | Influenza A virus strain A/Quail/Nanchang/4-040/2000 (H9N2) nucleoprotein (NP) gene, partial cds. |
| AY180564 | Influenza A virus (A/Wild Duck/Nanchang/2-0480/2000(H9N2)) nucleoprotein (NP) gene, partial cds. |
| AY180575 | Influenza A virus (A/Quail/Nanchang/2-0460/2000(H9N2)) nucleoprotein (NP) gene, partial cds. |
| AY496851 | Influenza A virus (A/chicken/Mudanjiang/0823/2000(H9N2)) nucleoprotein (np) mRNA, complete cds. |
| AY180581 | Influenza A virus (A/Chicken/Nanchang/1-0016/2000(H9N2)) nucleoprotein (NP) gene, partial cds. |
| AY180583 | Influenza A virus strain A/Duck/Nanchang/10-389/2000 (H9N2) nucleoprotein (NP) gene, partial cds. |
| AY180584 | Influenza A virus strain A/Duck/Nanchang/1-0070/2000 (H9N2) nucleoprotein (NP) gene, partial cds. |
| AY768567 | Influenza A virus (A/chicken/Korea/SNU0028/00(H9N2)) nucleocapsid protein (NP) gene, partial cds. |
| AY768568 | Influenza A virus (A/chicken/Korea/SNU0037/00(H9N2)) nucleocapsid protein (NP) gene, partial cds. |
| AY768569 | Influenza A virus (A/chicken/Korea/SNU0057/00(H9N2)) nucleocapsid protein (NP) gene, partial cds. |
| AY768570 | Influenza A virus (A/chicken/Korea/SNU0073/00(H9N2)) nucleocapsid protein (NP) gene, partial cds. |
| AY768571 | Influenza A virus (A/chicken/Korea/SNU0091/00(H9N2)) nucleocapsid protein (NP) gene, partial cds. |

TABLE 6-continued

| | |
|---|---|
| AY768572 | Influenza A virus (A/chicken/Korea/SNU0140/00(H9N2)) nucleocapsid protein (NP) gene, partial cds. |
| AY768573 | Influenza A virus (A/chicken/Korea/SNU0146/00(H9N2)) nucleocapsid protein (NP) gene, partial cds. |
| AY768574 | Influenza A virus (A/chicken/Korea/SNU1035C/00(H9N2)) nucleocapsid protein (NP) gene, partial cds. |
| AY268949 | Influenza A virus (A/chicken/Wangcheng/4/2001(H9N2)) nucleoprotein mRNA, complete cds. |
| AY180578 | Influenza A virus strain A/Chicken/Nanchang/4-301/2001 (H9N2) nucleoprotein (NP) gene, partial cds. |
| AY180551 | Influenza A virus (A/Chicken/Nanchang/4-361/2001(H9N2)) nucleoprotein (NP) gene, partial cds. |
| AF523418 | Influenza A virus (A/Duck/Shantou/2088/01(H9N2)) nucleocapsid protein (NP) gene, partial cds. |
| AF523414 | Influenza A virus (A/Duck/Shantou/1605/01(H9N2)) nucleocapsid protein (NP) gene, partial cds. |
| AF523412 | Influenza A virus (A/Wild Duck/Shantou/4808/01(H9N2)) nucleocapsid protein (NP) gene, partial cds. |
| AY800236 | Influenza A virus (A/chicken/Korea/S1/2003(H9N2)) nucleoprotein (NP) gene, partial cds. |
| AY862646 | Influenza A virus (A/silky chicken/Korea/S3/03(H9N2)) nucleocapsid protein (NP) gene, partial cds. |
| AY862647 | Influenza A virus (A/chicken/Korea/S4/03(H9N2)) nucleocapsid protein (NP) gene, partial cds. |
| AY862648 | Influenza A virus (A/chicken/Korea/S5/03(H9N2)) nucleocapsid protein (NP) gene, partial cds. |
| AY862649 | Influenza A virus (A/chicken/Korea/S12/03(H9N2)) nucleocapsid protein (NP) gene, partial cds. |
| AY862650 | Influenza A virus (A/duck/Korea/S13/03(H9N2)) nucleocapsid protein (NP) gene, partial cds. |
| AY862651 | Influenza A virus (A/dove/Korea/S14/03(H9N2)) nucleocapsid protein (NP) gene, partial cds. |
| AY862652 | Influenza A virus (A/chicken/Korea/S15/03(H9N2)) nucleocapsid protein (NP) gene, partial cds. |
| AY862653 | Influenza A virus (A/chicken/Korea/S16/03(H9N2)) nucleocapsid protein (NP) gene, partial cds. |
| AY862654 | Influenza A virus (A/chicken/Korea/S18/03(H9N2)) nucleocapsid protein (NP) gene, partial cds. |
| AY664717 | Influenza A virus (A/chicken/HongKong/CSW153/03(H9N2)) nucleoprotein (NP) gene, complete cds. |
| AY664718 | Influenza A virus (A/chicken/HongKong/AP45/03(H9N2)) nucleoprotein (NP) gene, complete cds. |
| AY664719 | Influenza A virus (A/chicken/HongKong/BD90/03(H9N2)) nucleoprotein (NP) gene, complete cds. |
| AY664720 | Influenza A virus (A/chicken/HongKong/CSW291/03(H9N2)) nucleoprotein (NP) gene, complete cds. |
| AY664721 | Influenza A virus (A/chicken/HongKong/CSW304/03(H9N2)) nucleoprotein (NP) gene, complete cds. |
| AY664722 | Influenza A virus (A/chicken/HongKong/FY23/03(H9N2)) nucleoprotein (NP) gene, complete cds. |
| AY664723 | Influenza A virus (A/guineafowl/HongKong/NT101/03(H9N2)) nucleoprotein (NP) gene, complete cds. |
| AY664724 | Influenza A virus (A/chicken/HongKong/NT142/03(H9N2)) nucleoprotein (NP) gene, complete cds. |
| AY664725 | Influenza A virus (A/chicken/HongKong/SF1/03(H9N2)) nucleoprotein (NP) gene, complete cds. |
| AY664726 | Influenza A virus (A/chicken/HongKong/SSP101/03(H9N2)) nucleoprotein (NP) gene, complete cds. |
| AY664727 | Influenza A virus (A/chicken/HongKong/TP38/03(H9N2)) nucleoprotein (NP) gene, complete cds. |
| AY664728 | Influenza A virus (A/chicken/HongKong/WF126/03(H9N2)) nucleoprotein (NP) gene, complete cds. |
| AY664729 | Influenza A virus (A/pigeon/HongKong/WF53/03(H9N2)) nucleoprotein (NP) gene, complete cds. |
| AY664730 | Influenza A virus (A/pheasant/HongKong/WF54/03(H9N2)) nucleoprotein (NP) gene, complete cds. |
| AY664731 | Influenza A virus (A/guineafowl/HongKong/NT184/03(H9N2)) nucleoprotein (NP) gene, complete cds. |
| AY664732 | Influenza A virus (A/chicken/HongKong/WF120/03(H9N2)) nucleoprotein (NP) gene, complete cds. |
| AY664733 | Influenza A virus (A/chicken/HongKong/NT366/03(H9N2)) nucleoprotein (NP) gene, partial cds. |
| AY664734 | Influenza A virus (A/chicken/HongKong/SSP418/03(H9N2)) nucleoprotein (NP) gene, partial cds. |
| AY664735 | Influenza A virus (A/chicken/HongKong/YU427/03(H9N2)) nucleoprotein (NP) gene, partial cds. |
| AY788915 | Influenza A virus (A/chicken/China/HSS2004(H9N2)) nucleoprotein (NP) gene, complete cds. |
| AY586423 | Influenza A virus (A/mallard/Italy/33/01(H7N3)) nucleoprotein gene, partial cds. |

TABLE 6-continued

| | |
|---|---|
| AY586424 | Influenza A Virus (A/mallard/Italy/43/01(H7N3)) nucleoprotein gene, partial cds. |
| AY586425 | Influenza A virus (A/turkey/Italy/220158/2002(H7N3)) nucleoprotein gene, partial cds. |
| AY586426 | Influenza A Virus (A/turkey/Italy/214845/02(H7N3)) nucleoprotein gene, partial cds. |
| AJ627486 | Influenza A virus (A/turkey/Italy/214845/2002(H7N3)) NP gene for nucleoprotein, genomic RNA. |
| AJ627495 | Influenza A virus (A/turkey/Italy/220158/2002(H7N3)) NP gene for nucleoprotein, genomic RNA. |
| AY303658 | Influenza A virus (A/chicken/Chile/176822/02(H7N3)) nucleoprotein gene, complete cds. |
| AY303659 | Influenza A virus (A/chicken/Chile/4957/02(H7N3)) nucleoprotein gene, complete cds. |
| AY611527 | Influenza A virus (A/chicken/British Columbia/04(H7N3)) nucleoprotein (NP) gene, complete cds. |
| AY646081 | Influenza A virus (A/chicken/British Columbia/GSC__human__B/04(H7N3)) nucleoprotein (NP) gene, complete cds. |
| AY648290 | Influenza A virus (A/GSC__chicken__B/British Columbia/04(H7N3)) nucleoprotein (NP) gene, complete cds. |
| AY650273 | Influenza A virus (A/GSC__chicken/British Columbia/04(H7N3)) nucleoprotein (NP) gene, complete cds. |
| AF144303 | Influenza A virus (A/Goose/Guangdong/1/96(H5N1)) nucleocapsid protein (NP) gene, complete cds. |
| AF046084 | Influenza A virus (A/Chicken/Hong Kong/220/97 (H5N1)) nucleoprotein gene, complete cds. |
| AF057293 | Influenza A virus (A/chicken/Hong Kong/258/97(H5N1)) nucleoprotein mRNA, complete cds. |
| AF098617 | Influenza A virus (A/Chicken/Hong Kong/y388/97 (H5N1)) nucleoprotein (NP) gene, complete cds. |
| AF098618 | Influenza A virus (A/Chicken/Hong Kong/728/97 (H5N1)) nucleoprotein (NP) gene, complete cds. |
| AF098619 | Influenza A virus (A/Chicken/Hong Kong/786/97 (H5N1)) nucleoprotein (NP) gene, complete cds. |
| AF098620 | Influenza A virus (A/Chicken/Hong Kong/915/97 (H5N1)) nucleoprotein (NP) gene, complete cds. |
| AF098621 | Influenza A virus (A/Duck/Hong Kong/p46/97 (H5N1)) nucleoprotein (NP) gene, complete cds. |
| AF098622 | Influenza A virus (A/Duck/Hong Kong/y283/97 (H5N1)) nucleoprotein (NP) gene, complete cds. |
| AF098623 | Influenza A virus (A/Goose/Hong Kong/w355/97 (H5N1)) nucleoprotein (NP) gene, complete cds. |
| AF370122 | Influenza A virus (A/Goose/Guangdong/3/97(H5N1)) nucleoprotein gene, complete cds. |
| AF216712 | Influenza A virus (A/Environment/Hong Kong/437-4/99 (H5N1)) nucleoprotein gene, complete cds. |
| AF216720 | Influenza A virus (A/Environment/Hong Kong/437-6/99 (H5N1)) nucleoprotein gene, complete cds. |
| AF216728 | Influenza A virus (A/Environment/Hong Kong/437-8/99 (H5N1)) nucleoprotein gene, complete cds. |
| AF216736 | Influenza A virus (A/Environment/Hong Kong/437-10/99 (H5N1)) nucleoprotein gene, complete cds. |
| AY585429 | Influenza A virus (A/duck/Guangxi/07/1999(H5N1)) nucleoprotein (NP) mRNA, complete cds. |
| AY585439 | Influenza A virus (A/duck/Zhejiang/11/2000(H5N1)) nucleoprotein (NP) mRNA, complete cds. |
| AY585440 | Influenza A virus (A/duck/Zhejiang/52/2000(H5N1)) nucleoprotein (NP) mRNA, complete cds. |
| AY585428 | Influenza A virus (A/duck/Guangdong/40/2000(H5N1)) nucleoprotein (NP) mRNA, complete cds. |
| AY585423 | Influenza A virus (A/duck/Fujian/19/2000(H5N1)) nucleoprotein (NP) mRNA, complete cds. |
| AY585425 | Influenza A virus (A/duck/Guangdong/07/2000(H5N1)) nucleoprotein (NP) mRNA, complete cds. |
| AY585426 | Influenza A virus (A/duck/Guangdong/12/2000(H5N1)) nucleoprotein (NP) mRNA, complete cds. |
| AY059492 | Influenza A virus (A/Goose/Hong Kong/ww26/2000(H5N1)) segment 5 nucleocapsid protein (NP) gene, partial cds. |
| AY059493 | Influenza A virus (A/Goose/Hong Kong/ww28/2000(H5N1)) segment 5 nucleocapsid protein (NP) gene, partial cds. |
| AY059494 | Influenza A virus (A/Duck/Hong Kong/ww381/2000(H5N1)) segment 5 nucleocapsid protein (NP) gene, partial cds. |
| AY059495 | Influenza A virus (A/Duck/Hong Kong/ww461/2000(H5N1)) segment 5 nucleocapsid protein (NP) gene, partial cds. |
| AY059496 | Influenza A virus (A/Goose/Hong Kong/ww491/2000(H5N1)) segment 5 nucleocapsid protein (NP) gene, partial cds. |
| AY059497 | Influenza A virus (A/Duck/Hong Kong/2986.1/2000(H5N1)) segment 5 nucleocapsid protein (NP) gene, partial cds. |
| AY059498 | Influenza A virus (A/Goose/Hong Kong/3014.8/2000(H5N1)) segment 5 nucleocapsid protein (NP) gene, partial cds. |

TABLE 6-continued

| | |
|---|---|
| AF398419 | Influenza A virus (A/Goose/Hong Kong/385.3/2000(H5N1)) nucleocapsid protein (NP) gene, partial cds. |
| AF398420 | Influenza A virus (A/Goose/Hong Kong/385.5/2000(H5N1)) nucleocapsid protein (NP) gene, partial cds. |
| AF468842 | Influenza A virus (A/Duck/Anyang/AVL-1/2001(H5N1)) nucleoprotein (NP) gene, complete cds. |
| AF509117 | Influenza A virus (A/Chicken/Hong Kong/FY77/01 (H5N1)) nucleocapsid protein (NP) gene, complete cds. |
| AF509118 | Influenza A virus (A/Chicken/Hong Kong/YU562/01 (H5N1)) nucleocapsid protein (NP) gene, complete cds. |
| AF509119 | Influenza A virus (A/Chicken/Hong Kong/YU563/01 (H5N1)) nucleocapsid protein (NP) gene, complete cds. |
| AY585438 | Influenza A virus (A/duck/Shanghai/38/2001(H5N1)) nucleoprotein (NP) mRNA, complete cds. |
| AY221548 | Influenza A virus (A/Chicken/HongKong/NT873.3/01-MB(H5N1)) nucleocapsid protein (NP) gene, partial cds. |
| AY221549 | Influenza A virus (A/Chicken/HongKong/NT873.3/01(H5N1)) nucleocapsid protein (NP) gene, partial cds. |
| AY221550 | Influenza A virus (A/Chicken/HongKong/FY150/01-MB(H5N1)) nucleocapsid protein (NP) gene, partial cds. |
| AY221551 | Influenza A virus (A/Chicken/HongKong/FY150/01(H5N1)) nucleocapsid protein (NP) gene, partial cds. |
| AY221552 | Influenza A virus (A/Pheasant/HongKong/FY155/01-MB(H5N1)) nucleocapsid protein (NP) gene, partial cds. |
| AY221553 | Influenza A virus (A/Pheasant/HongKong/FY155/01(H5N1)) nucleocapsid protein (NP) gene, partial cds. |
| AY221554 | Influenza A virus (A/Chicken/HongKong/YU822.2/01-MB(H5N1)) nucleocapsid protein (NP) gene, partial cds. |
| AY221555 | Influenza A virus (A/Chicken/HongKong/YU822.2/01(H5N1)) nucleocapsid protein (NP) gene, partial cds. |
| AY221556 | Influenza A virus (A/Chicken/HongKong/YU562/01(H5N1)) nucleocapsid protein (NP) gene, partial cds. |
| AF509120 | Influenza A virus (A/Chicken/Hong Kong/FY150/01 (H5N1)) nucleocapsid protein (NP) gene, complete cds. |
| AF509121 | Influenza A virus (A/Pheasant/Hong Kong/FY155/01 (H5N1)) nucleocapsid protein (NP) gene, complete cds. |
| AF509122 | Influenza A virus (A/Silky Chicken/Hong Kong/SF189/01 (H5N1)) nucleocapsid protein (NP) gene, partial cds. |
| AF509123 | Influenza A virus (A/Quail/Hong Kong/SF203/01 (H5N1)) nucleocapsid protein (NP) gene, partial cds. |
| AF509124 | Influenza A virus (A/Pigeon/Hong Kong/SF215/01 (H5N1)) nucleocapsid protein (NP) gene, partial cds. |
| AF509125 | Influenza A virus (A/Chicken/Hong Kong/SF219/01 (H5N1)) nucleocapsid protein (NP) gene, partial cds. |
| AF509126 | Influenza A virus (A/Chicken/Hong Kong/715.5/01 (H5N1)) nucleocapsid protein (NP) gene, partial cds. |
| AF509127 | Influenza A virus (A/Chicken/Hong Kong/751.1/01 (H5N1)) nucleocapsid protein (NP) gene, partial cds. |
| AF509128 | Influenza A virus (A/Chicken/Hong Kong/822.1/01 (H5N1)) nucleocapsid protein (NP) gene, partial cds. |
| AF509129 | Influenza A virus (A/Chicken/Hong Kong/829.2/01 (H5N1)) nucleocapsid protein (NP) gene, partial cds. |
| AF509130 | Influenza A virus (A/Chicken/Hong Kong/830.2/01 (H5N1)) nucleocapsid protein (NP) gene, partial cds. |
| AF509131 | Influenza A virus (A/Chicken/Hong Kong/858.3/01 (H5N1)) nucleocapsid protein (NP) gene, partial cds. |
| AF509132 | Influenza A virus (A/Chicken/Hong Kong/866.3/01 (H5N1)) nucleocapsid protein (NP) gene, partial cds. |
| AF509133 | Influenza A virus (A/Chicken/Hong Kong/867.1/01 (H5N1)) nucleocapsid protein (NP) gene, partial cds. |
| AF509134 | Influenza A virus (A/Chicken/Hong Kong/879.1/01 (H5N1)) nucleocapsid protein (NP) gene, partial cds. |
| AF509135 | Influenza A virus (A/Chicken/Hong Kong/873.3/01 (H5N1)) nucleocapsid protein (NP) gene, partial cds. |
| AF509136 | Influenza A virus (A/Chicken/Hong Kong/876.1/01 (H5N1)) nucleocapsid protein (NP) gene, partial cds. |
| AF509137 | Influenza A virus (A/Chicken/Hong Kong/891.1/01 (H5N1)) nucleocapsid protein (NP) gene, partial cds. |
| AF509138 | Influenza A virus (A/Chicken/Hong Kong/893.2/01 (H5N1)) nucleocapsid protein (NP) gene, partial cds. |
| AF509139 | Influenza A virus (A/Goose/Hong Kong/76.1/01 (H5N1)) nucleocapsid protein (NP) gene, complete cds. |
| AF509140 | Influenza A virus (A/Goose/Hong Kong/ww100/01 (H5N1)) nucleocapsid protein (NP) gene, partial cds. |
| AF509141 | Influenza A virus (A/Duck/Hong Kong/573.4/01 (H5N1)) nucleocapsid protein (NP) gene, partial cds. |
| AF509142 | Influenza A virus (A/Duck/Hong Kong/646.3/01 (H5N1)) nucleocapsid protein (NP) gene, partial cds. |
| AY585424 | Influenza A virus (A/duck/Guangdong/01/2001(H5N1)) nucleoprotein (NP) mRNA, complete cds. |

TABLE 6-continued

| | |
|---|---|
| AY585422 | Influenza A virus (A/duck/Fujian/17/2001(H5N1)) nucleoprotein (NP) mRNA, complete cds. |
| AY585430 | Influenza A virus (A/duck/Guangxi/22/2001(H5N1)) nucleoprotein (NP) mRNA, complete cds. |
| AY585431 | Influenza A virus (A/duck/Guangxi/35/2001(H5N1)) nucleoprotein (NP) mRNA, complete cds. |
| AY585432 | Influenza A virus (A/duck/Guangxi/50/2001(H5N1)) nucleoprotein (NP) mRNA, complete cds. |
| AY585434 | Influenza A virus (A/duck/Shanghai/08/2001(H5N1)) nucleoprotein (NP) mRNA, complete cds. |
| AY585435 | Influenza A virus (A/duck/Shanghai/13/2001(H5N1)) nucleoprotein (NP) mRNA, complete cds. |
| AY585436 | Influenza A virus (A/duck/Shanghai/35/2002(H5N1)) nucleoprotein (NP) mRNA, complete cds. |
| AY585437 | Influenza A virus (A/duck/Shanghai/37/2002(H5N1)) nucleoprotein (NP) mRNA, complete cds. |
| AY585433 | Influenza A virus (A/duck/Guangxi/53/2002(H5N1)) nucleoprotein (NP) mRNA, complete cds. |
| AY585427 | Influenza A virus (A/duck/Guangdong/22/2002(H5N1)) nucleoprotein (NP) mRNA, complete cds. |
| AY585420 | Influenza A virus (A/duck/Fujian/01/2002(H5N1)) nucleoprotein (NP) mRNA, complete cds. |
| AY585421 | Influenza A virus (A/duck/Fujian/13/2002(H5N1)) nucleoprotein (NP) mRNA, complete cds. |
| AY575907 | Influenza A virus (A/Gs/HK/739.2/02 (H5N1)) nucleocapsid protein (NP) gene, partial cds. |
| AY575908 | Influenza A virus (A/Eg/HK/757.3/02 (H5N1)) nucleocapsid protein (NP) gene, partial cds. |
| AY575909 | Influenza A virus (A/G.H/HK/793.1/02 (H5N1)) nucleocapsid protein (NP) gene, partial cds. |
| AY575910 | Influenza A virus (A/Dk/HK/821/02 (H5N1)) nucleocapsid protein (NP) gene, partial cds. |
| AY575911 | Influenza A virus (A/Ck/HK/31.4/02 (H5N1)) nucleocapsid protein (NP) gene, complete cds. |
| AY575912 | Influenza A virus (A/Ck/HK/61.9/02 (H5N1)) nucleocapsid protein (NP) gene, complete cds. |
| AY575913 | Influenza A virus (A/Ck/HK/YU777/02 (H5N1)) nucleocapsid protein (NP) gene, partial cds. |
| AY575914 | Influenza A virus (A/Ck/HK/96.1/02 (H5N1)) nucleocapsid protein (NP) gene, partial cds. |
| AY575915 | Influenza A virus (A/Ck/HK/409.1/02 (H5N1)) nucleocapsid protein (NP) gene, partial cds. |
| AY575916 | Influenza A virus (A/Ph/HK/sv674.15/02 (H5N1)) nucleocapsid protein (NP) gene, partial cds. |
| DQ023146 | Influenza A virus (A/chicken/sd/1/02(H5N1)) nucleoprotein (NP) mRNA, complete cds. |
| AY676037 | Influenza A virus (A/duck/Hong Kong/821/02(H5N1)) nucleoprotein (NP) gene, complete cds. |
| AY651510 | Influenza A virus (A/Gf/HK/38/2002(H5N1)) nucleocapsid protein (NP) gene, complete cds. |
| AY651511 | Influenza A virus (A/Ck/HK/31.2/2002(H5N1)) nucleocapsid protein (NP) gene, complete cds. |
| AY651512 | Influenza A virus (A/Ck/HK/37.4/2002(H5N1)) nucleocapsid protein (NP) gene, complete cds. |
| AY651513 | Influenza A virus (A/SCk/HK/YU100/2002(H5N1)) nucleocapsid protein (NP) gene, complete cds. |
| AY651514 | Influenza A virus (A/Ck/HK/YU22/2002(H5N1)) nucleocapsid protein (NP) gene, partial cds. |
| AY651521 | Influenza A virus (A/Ck/HK/3176.3/2002(H5N1)) nucleocapsid protein (NP) gene, partial cds. |
| AY651522 | Influenza A virus (A/Ck/HK/3169.1/2002(H5N1)) nucleocapsid protein (NP) gene, partial cds. |
| AY651524 | Influenza A virus (A/feral pigeon/HK/862.7/2002(H5N1)) nucleocapsid protein (NP) gene, partial cds. |
| AY651525 | Influenza A virus (A/tree sparrow/HK/864/2002(H5N1)) nucleocapsid protein (NP) gene, partial cds. |
| AY651526 | Influenza A virus (A/grey heron/HK/861.1/2002(H5N1)) nucleocapsid protein (NP) gene, partial cds. |
| AY651527 | Influenza A virus (A/teal/China/2978.1/2002(H5N1)) nucleocapsid protein (NP) gene, partial cds. |
| AY651523 | Influenza A virus (A/black headed gull/HK/12.1/2003(H5N1)) nucleocapsid protein (NP) gene, partial cds. |
| AY651487 | Influenza A virus (A/Ck/Indonesia/PA/2003(H5N1)) nucleocapsid protein (NP) gene, partial cds. |
| AY651515 | Influenza A virus (A/Ck/HK/2133.1/2003(H5N1)) nucleocapsid protein (NP) gene, partial cds. |
| AY651516 | Influenza A virus (A/Ck/HK/NT93/2003(H5N1)) nucleocapsid protein (NP) gene, partial cds. |
| AY651517 | Influenza A virus (A/Ck/HK/SSP141/2003(H5N1)) nucleocapsid protein (NP) gene, partial cds. |

TABLE 6-continued

| | |
|---|---|
| AY651518 | Influenza A virus (A/Ck/HK/WF157/2003(H5N1)) nucleocapsid protein (NP) gene, partial cds. |
| AY651519 | Influenza A virus (A/Ck/HK/FY157/2003(H5N1)) nucleocapsid protein (NP) gene, partial cds. |
| AY651520 | Influenza A virus (A/Ck/HK/YU324/2003(H5N1)) nucleocapsid protein (NP) gene, partial cds. |
| AY651490 | Influenza A virus (A/Ck/Indonesia/2A/2003(H5N1)) nucleocapsid protein (NP) gene, partial cds. |
| AY676038 | Influenza A virus (A/egret/Hong Kong/757.2/03(H5N1)) nucleoprotein (NP) gene, complete cds. |
| AY676039 | Influenza A virus (A/chicken/Korea/ES/03(H5N1)) nucleoprotein (NP) gene, complete cds. |
| AY676040 | Influenza A virus (A/duck/Korea/ESD1/03(H5N1)) nucleoprotein (NP) gene, complete cds. |
| AY651529 | Influenza A virus (A/Dk/HN/5806/2003(H5N1)) nucleocapsid protein (NP) gene, partial cds. |
| AY651532 | Influenza A virus (A/Ck/ST/4231/2003(H5N1)) nucleocapsid protein (NP) gene, partial cds. |
| AY651534 | Influenza A virus (A/Dk/ST/4003/2003(H5N1)) nucleocapsid protein (NP) gene, partial cds. |
| AY651535 | Influenza A virus (A/Dk/YN/6255/2003(H5N1)) nucleocapsid protein (NP) gene, partial cds. |
| AY651536 | Influenza A virus (A/Dk/YN/6445/2003(H5N1)) nucleocapsid protein (NP) gene, partial cds. |
| AY651485 | Influenza A virus (A/Ck/Indonesia/BL/2003(H5N1)) nucleocapsid protein (NP) gene, partial cds. |
| AY518364 | Influenza A virus (A/duck/China/E319-2/03(H5N1)) nucleocapsid protein (NP) gene, complete cds. |
| AY574189 | Influenza A virus (A/chicken/Vietnam/HD1/2004(H5N1)) nucleoprotein gene, partial cds. |
| AY574192 | Influenza A virus (A/chicken/Vietnam/HD2/2004(H5N1)) nucleoprotein gene, partial cds. |
| AJ867076 | Influenza A virus (A/Hatay/2004/(H5N1)) NP gene for nucleoprotein, genomic RNA |
| AY651486 | Influenza A virus (A/Dk/Indonesia/MS/2004(H5N1)) nucleocapsid protein (NP) gene, partial cds. |
| AY590579 | Influenza A virus (A/chicken/Nakorn-Patom/Thailand/CU-K2/2004(H5N1)) nucleocapsid protein (NP) gene, complete cds. |
| AY609313 | Influenza A virus (A/chicken/Guangdong/174/04(H5N1)) segment 5, complete sequence. |
| AY576929 | Influenza A virus (A/chicken/Vietnam/CM/2004(H5N1)) segment 5 nucleoprotein gene, partial cds. |
| AY576931 | Influenza A virus (A/muscovy duck/Vietnam/MdGL/2004(H5N1)) segment 5 nucleoprotein gene, partial cds. |
| AB166863 | Influenza A virus (A/chicken/Yamaguchi/7/2004(H5N1)) NP gene for nucleoprotein, complete cds. |
| AB188817 | Influenza A virus (A/chicken/Oita/8/2004(H5N1)) NP gene for nucleoprotein, complete cds. |
| AY651537 | Influenza A virus (A/Ck/YN/374/2004(H5N1)) nucleocapsid protein (NP) gene, partial cds. |
| AY651538 | Influenza A virus (A/Ck/YN/115/2004(H5N1)) nucleocapsid protein (NP) gene, partial cds. |
| AY653196 | Influenza A virus (A/chicken/Jilin/9/2004(H5N1)) segment 5, complete sequence. |
| AY651533 | Influenza A virus (A/Ph/ST/44/2004(H5N1)) nucleocapsid protein (NP) gene, partial cds. |
| AY651530 | Influenza A virus (A/Dk/HN/303/2004(H5N1)) nucleocapsid protein (NP) gene, partial cds. |
| AY651531 | Influenza A virus (A/Dk/HN/101/2004(H5N1)) nucleocapsid protein (NP) gene, partial cds. |
| AY684707 | Influenza A virus (A/chicken/Hubei/327/2004(H5N1)) nucleoprotein (NP) gene, complete cds. |
| AY737290 | Influenza A virus (A/chicken/Guangdong/191/04(H5N1)) segment 5, complete sequence. |
| AY737297 | Influenza A virus (A/chicken/Guangdong/178/04(H5N1)) segment 5, complete sequence. |
| AY737305 | Influenza A virus (A/duck/Guangdong/173/04(H5N1)) segment 5, complete sequence. |
| AY770081 | Influenza A virus (A/chicken/Hubei/489/2004(H5N1)) nucleoprotein (NP) gene, complete cds. |
| AY770996 | Influenza A virus (A/chicken/Ayutthaya/Thailand/CU-23/04(H5N1)) nucleoprotein gene, partial cds. |
| AY818139 | Influenza A virus (A/chicken/Vietnam/C58/04(H5N1)) nucleoprotein NP gene, complete cds. |
| AY818140 | Influenza A virus (A/quail/Vietnam/36/04(H5N1)) nucleoprotein NP gene, complete cds. |
| AY856864 | Influenza A virus (A/duck/Shandong/093/2004(H5N1)) segment 5, complete sequence. |
| AB189046 | Influenza A virus (A/chicken/Kyoto/3/2004(H5N1)) NP gene for nucleoprotein, complete cds,. |

TABLE 6-continued

| | |
|---|---|
| AB189054 | Influenza A virus (A/crow/Kyoto/53/2004(H5N1)) NP gene for nucleoprotein, complete cds,. |
| AB189062 | Influenza A virus (A/crow/Osaka/102/2004(H5N1)) NP gene for nucleoprotein, complete cds,. |
| AY651491 | Influenza A virus (A/Ck/Thailand/1/2004(H5N1)) nucleocapsid protein (NP) gene, partial cds. |
| AY651492 | Influenza A virus (A/Ck/Thailand/73/2004(H5N1)) nucleocapsid protein (NP) gene, partial cds. |
| AY651493 | Influenza A virus (A/Ck/Thailand/9.1/2004(H5N1)) nucleocapsid protein (NP) gene, partial cds. |
| AY651494 | Influenza A virus (A/Qa/Thailand/57/2004(H5N1)) nucleocapsid protein (NP) gene, partial cds. |
| AY651495 | Influenza A virus (A/bird/Thailand/3.1/2004(H5N1)) nucleocapsid protein (NP) gene, partial cds. |
| AY651496 | Influenza A virus (A/Dk/Thailand/71.1/2004(H5N1)) nucleocapsid protein (NP) gene, partial cds. |
| AY651497 | Influenza A virus (A/Gs/Thailand/79/2004(H5N1)) nucleocapsid protein (NP) gene, partial cds. |
| AY651502 | Influenza A virus (A/Ck/Viet Nam/33/2004(H5N1)) nucleocapsid protein (NP) gene, partial cds. |
| AY651503 | Influenza A virus (A/Ck/Viet Nam/35/2004(H5N1)) nucleocapsid protein (NP) gene, partial cds. |
| AY651504 | Influenza A virus (A/Ck/Viet Nam/36/2004(H5N1)) nucleocapsid protein (NP) gene, partial cds. |
| AY651505 | Influenza A virus (A/Ck/Viet Nam/37/2004(H5N1)) nucleocapsid protein (NP) gene, partial cds. |
| AY651506 | Influenza A virus (A/Ck/Viet Nam/38/2004(H5N1)) nucleocapsid protein (NP) gene, partial cds. |
| AY651507 | Influenza A virus (A/Ck/Viet Nam/39/2004(H5N1)) nucleocapsid protein (NP) gene, partial cds. |
| AY651508 | Influenza A virus (A/Ck/Viet Nam/C57/2004(H5N1)) nucleocapsid protein (NP) gene, partial cds. |
| AY651509 | Influenza A virus (A/Dk/Viet Nam/11/2004(H5N1)) nucleocapsid protein (NP) gene, partial cds. |
| AY651488 | Influenza A virus (A/Ck/Indonesia/4/2004(H5N1)) nucleocapsid protein (NP) gene, partial cds. |
| AY651489 | Influenza A virus (A/Ck/Indonesia/5/2004(H5N1)) nucleocapsid protein (NP) gene, partial cds. |
| AY651528 | Influenza A virus (A/peregrine falcon/HK/D0028/2004(H5N1)) nucleocapsid protein (NP) gene, partial cds. |
| M22573 | Influenza A/duck/Hong Kong/7/75 (H3N2), nucleoprotein (seg 5), RNA. |
| AY180555 | Influenza A virus (A/Chicken/Nanchang/3-120/2001(H3N2)) nucleoprotein (NP) gene, partial cds. |
| AY779261 | Influenza A virus (A/turkey/North Carolina/12344/03(H3N2)) nucleoprotein (NP) gene, partial cds. |
| AY779262 | Influenza A virus (A/turkey/Minnesota/764-2/03(H3N2)) nucleoprotein (NP) gene, partial cds. |
| AY862655 | Influenza A virus (A/chicken/Korea/S6/03(H3N2)) nucleocapsid protein (NP) gene, partial cds. |
| AY862656 | Influenza A virus (A/duck/Korea/S7/03(H3N2)) nucleocapsid protein (NP) gene, partial cds. |
| AY862657 | Influenza A virus (A/duck/Korea/S8/03(H3N2)) nucleocapsid protein (NP) gene, partial cds. |
| AY862658 | Influenza A virus (A/duck/Korea/S9/03(H3N2)) nucleocapsid protein (NP) gene, partial cds. |
| AY862659 | Influenza A virus (A/duck/Korea/S10/03(H3N2)) nucleocapsid protein (NP) gene, partial cds. |
| AY862660 | Influenza A virus (A/dove/Korea/S11/03(H3N2)) nucleocapsid protein (NP) gene, partial cds. |
| D00050 | Influenza A virus gene for nucleoprotein, complete cds. |
| M14921 | Influenza A/Mallard/NY/6750/78 (H2N2) nucleoprotein (seg 5) RNA, complete cds. |
| AY422026 | Influenza A virus (A/duck/Hokkaido/95/01(H2N2)) nucleoprotein (NP) gene, partial cds. |
| U49093 | Influenza A virus nucleoprotein (NP) mRNA, partial cds. |
| M22574 | Influenza A/duck/Bavaria/2/77 (H1N1), nucleoprotein (seg 5), RNA. |
| M76603 | Influenza A/turkey/England/647/77 (H1N1) mRNA, complete cds. |
| M63783 | Influenza A/Duck/Australia/749/80 (H1N1) nucleoprotein mRNA, complete cds. |
| M63778 | Influenza A/Turkey/Minnesota/1661/81 (H1N1) nucleoprotein mRNA, complete cds. |
| Z26855 | Influenza virus type A NP gene for nucleoprotein |
| M76609 | Influenza A/turkey/North Carolina/1790/88 (H1N1) mRNA, complete cds. |
| Z26857 | Influenza virus type A NP gene for nucleoprotein |
| AF213905 | Influenza A virus (A/Mallard/Italy/24/95(H1N1)) segment 5 nucleoprotein (NP) gene, partial cds. |

TABLE 6-continued

| | |
|---|---|
| AF213906 | Influenza A virus (A/Chicken/Italy/24/95(H1N1)) segment 5 nucleoprotein (NP) gene, partial cds. |
| AY633215 | Influenza A virus (A/mallard/Alberta/211/98(H1N1)) nucleoprotein (NP) gene, complete cds. |
| AY180543 | Influenza A virus (A/Quail/Nanchang/12-340/2000(H1N1)) nucleoprotein (NP) gene, partial cds. |
| Sequences used in analysis of Influenza A Polymerase Basic protein 1 (PB1) | |
| AY633218 | Influenza A virus (A/mallard/Alberta/211/98(H1N1)) RNA-directed RNA polymerase subunit P1 (PB1) gene, partial cds. |
| U48284 | Influenza A virus polymerase (PB1) mRNA, partial cds. |
| AY180855 | Influenza A virus strain A/Quail/Nanchang/12-340/2000 (H1N1) polymerase subunit PB1 (PB1) gene, partial cds. |
| AY422038 | Influenza A virus (A/duck/Hokkaido/95/01(H2N2)) polymerase subunit (PB1) gene, partial cds. |
| M25926 | Influenza A/Mallard/New York/6750/78 (H2N2) PB1 gene, complete cds. |
| AY180871 | Influenza A virus strain A/Chicken/Nanchang/3-120/2001 (H3N2) polymerase subunit PB1 (PB1) gene, partial cds. |
| AY779265 | Influenza A virus (A/turkey/North Carolina/12344/03(H3N2)) polymerase basic protein 1 (PB1) gene, partial cds. |
| AY779266 | Influenza A virus (A/turkey/Minnesota/764-2/03(H3N2)) polymerase basic protein 1 (PB1) gene, partial cds. |
| AY862703 | Influenza A virus (A/chicken/Korea/S6/03(H3N2)) PB1 (PB1) gene, partial cds. |
| AY862704 | Influenza A virus (A/duck/Korea/S7/03(H3N2)) PB1 (PB1) gene, partial cds. |
| AY862705 | Influenza A virus (A/duck/Korea/S8/03(H3N2)) PB1 (PB1) gene, partial cds. |
| AY862706 | Influenza A virus (A/duck/Korea/S9/03(H3N2)) PB1 (PB1) gene, partial cds. |
| AY862707 | Influenza A virus (A/duck/Korea/S10/03(H3N2)) PB1 (PB1) gene, partial cds. |
| AY862708 | Influenza A virus (A/dove/Korea/S11/03(H3N2)) PB1 (PB1) gene, partial cds. |
| AF213911 | Influenza A virus (A/Chicken/Italy/5945/95(H3N2)) segment 8 PB1 polymerase protein gene, partial cds. |
| AB166860 | Influenza A virus (A/chicken/Yamaguchi/7/2004(H5N1)) PB1 gene for polymerase basic protein 1, complete cds. |
| AB188814 | Influenza A virus (A/chicken/Oita/8/2004(H5N1)) PB1 gene for polymerase basic protein 1, complete cds. |
| AF398423 | Influenza A virus (A/Goose/Hong Kong/385.3/2000(H5N1)) polymerase (PB1) gene, partial cds. |
| AF398424 | Influenza A virus (A/Goose/Hong Kong/385.5/2000(H5N1)) polymerase (PB1) gene, partial cds. |
| AF468839 | Influenza A virus (A/Duck/Anyang/AVL-1/2001(H5N1)) polymerase basic protein 1 (PB1) gene, complete cds. |
| AF509169 | Influenza A virus (A/Chicken/Hong Kong/FY77/01 (H5N1)) polymerase (PB1) gene, partial cds. |
| AF509170 | Influenza A virus (A/Chicken/Hong Kong/YU562/01 (H5N1)) polymerase (PB1) gene, partial cds. |
| AF509171 | Influenza A virus (A/Chicken/Hong Kong/YU563/01 (H5N1)) polymerase (PB1) gene, partial cds. |
| AF509172 | Influenza A virus (A/Chicken/Hong Kong/FY150/01 (H5N1)) polymerase (PB1) gene, partial cds. |
| AF509173 | Influenza A virus (A/Pheasant/Hong Kong/FY155/01 (H5N1)) polymerase (PB1) gene, partial cds. |
| AF509174 | Influenza A virus (A/Silky Chicken/Hong Kong/SF189/01 (H5N1)) polymerase (PB1) gene, partial cds. |
| AF509175 | Influenza A virus (A/Quail/Hong Kong/SF203/01 (H5N1)) polymerase (PB1) gene, partial cds. |
| AF509176 | Influenza A virus (A/Pigeon/Hong Kong/SF215/01 (H5N1)) polymerase (PB1) gene, partial cds. |
| AF509177 | Influenza A virus (A/Chicken/Hong Kong/SF219/01 (H5N1)) polymerase (PB1) gene, partial cds. |
| AF509178 | Influenza A virus (A/Chicken/Hong Kong/715.5/01 (H5N1)) polymerase (PB1) gene, partial cds. |
| AF509179 | Influenza A virus (A/Chicken/Hong Kong/751.1/01 (H5N1)) polymerase (PB1) gene, partial cds. |
| AF509180 | Influenza A virus (A/Chicken/Hong Kong/822.1/01 (H5N1)) polymerase (PB1) gene, partial cds. |
| AF509181 | Influenza A virus (A/Chicken/Hong Kong/829.2/01 (H5N1)) polymerase (PB1) gene, partial cds. |
| AF509182 | Influenza A virus (A/Chicken/Hong Kong/830.2/01 (H5N1)) polymerase (PB1) gene, partial cds. |
| AF509183 | Influenza A virus (A/Chicken/Hong Kong/858.3/01 (H5N1)) polymerase (PB1) gene, partial cds. |
| AF509184 | Influenza A virus (A/Chicken/Hong Kong/866.3/01 (H5N1)) polymerase (PB1) gene, partial cds. |

TABLE 6-continued

| | |
|---|---|
| AF509185 | Influenza A virus (A/Chicken/Hong Kong/867.1/01 (H5N1)) polymerase (PB1) gene, partial cds. |
| AF509186 | Influenza A virus (A/Chicken/Hong Kong/879.1/01 (H5N1)) polymerase (PB1) gene, partial cds. |
| AF509187 | Influenza A virus (A/Chicken/Hong Kong/873.3/01 (H5N1)) polymerase (PB1) gene, partial cds. |
| AF509188 | Influenza A virus (A/Chicken/Hong Kong/876.1/01 (H5N1)) polymerase (PB1) gene, partial cds. |
| AF509189 | Influenza A virus (A/Chicken/Hong Kong/891.1/01 (H5N1)) polymerase (PB1) gene, partial cds. |
| AF509190 | Influenza A virus (A/Chicken/Hong Kong/893.2/01 (H5N1)) polymerase (PB1) gene, partial cds. |
| AF509191 | Influenza A virus (A/Goose/Hong Kong/76.1/01 (H5N1)) polymerase (PB1) gene, partial cds. |
| AF509192 | Influenza A virus (A/Goose/Hong Kong/ww100/01 (H5N1)) polymerase (PB1) gene, partial cds. |
| AF509193 | Influenza A virus (A/Duck/Hong Kong/573.4/01 (H5N1)) polymerase (PB1) gene, partial cds. |
| AF509194 | Influenza A virus (A/Duck/Hong Kong/646.3/01 (H5N1)) polymerase (PB1) gene, partial cds. |
| AY035888 | Influenza A virus (A/goose/Guangdong/3/97(H5N1)) polymerase basic protein 1 (PB1) gene, complete cds. |
| AY059513 | Influenza A virus (A/Goose/Hong Kong/ww26/2000(H5N1)) segment 2 polymerase (PB1) gene, partial cds. |
| AY059514 | Influenza A virus (A/Goose/Hong Kong/ww28/2000(H5N1)) segment 2 polymerase (PB1) gene, partial cds. |
| AY059515 | Influenza A virus (A/Duck/Hong Kong/ww381/2000(H5N1)) segment 2 polymerase (PB1) gene, partial cds. |
| AY059516 | Influenza A virus (A/Duck/Hong Kong/ww461/2000(H5N1)) segment 2 polymerase (PB1) gene, partial cds. |
| AY059517 | Influenza A virus (A/Goose/Hong Kong/ww491/2000(H5N1)) segment 2 polymerase (PB1) gene, partial cds. |
| AY059518 | Influenza A virus (A/Duck/Hong Kong/2986.1/2000(H5N1)) segment 2 polymerase (PB1) gene, partial cds. |
| AY059519 | Influenza A virus (A/Goose/Hong Kong/3014.8/2000(H5N1)) segment 2 polymerase (PB1) gene, partial cds. |
| AY221575 | Influenza A virus (A/Chicken/HongKong/NT873.3/01-MB(H5N1)) polymerase basic protein 1 (PB1) gene, partial cds. |
| AY221576 | Influenza A virus (A/Chicken/HongKong/NT873.3/01(H5N1)) polymerase basic protein 1 (PB1) gene, partial cds. |
| AY221577 | Influenza A virus (A/Chicken/HongKong/FY150/01-MB(H5N1)) polymerase basic protein 1 (PB1) gene, partial cds. |
| AY221578 | Influenza A virus (A/Chicken/HongKong/FY150/01(H5N1)) polymerase basic protein 1 (PB1) gene, partial cds. |
| AY221579 | Influenza A virus (A/Pheasant/HongKong/FY155/01-MB(H5N1)) polymerase basic protein 1 (PB1) gene, partial cds. |
| AY221580 | Influenza A virus (A/Pheasant/HongKong/FY155/01(H5N1)) polymerase basic protein 1 (PB1) gene, partial cds. |
| AY221581 | Influenza A virus (A/Chicken/HongKong/YU822.2/01-MB(H5N1)) polymerase basic protein 1 (PB1) gene, partial cds. |
| AY221582 | Influenza A virus (A/Chicken/HongKong/YU822.2/01(H5N1)) polymerase basic protein 1 (PB1) gene, partial cds. |
| AY221583 | Influenza A virus (A/Chicken/HongKong/YU562/01(H5N1)) polymerase basic protein 1 (PB1) gene, partial cds. |
| AY518366 | Influenza A virus (A/duck/China/E319-2/03(H5N1)) polymerase subunit PB1 (PB1) gene, complete cds. |
| AY576394 | Influenza A virus (A/Gs/HK/739.2/02 (H5N1)) polymerase (PB1) gene, partial cds. |
| AY576395 | Influenza A virus (A/Eg/HK/757.3/02 (H5N1)) polymerase (PB1) gene, partial cds. |
| AY576396 | Influenza A virus (A/G.H/HK/793.1/02 (H5N1)) polymerase (PB1) gene, partial cds. |
| AY576397 | Influenza A virus (A/Dk/HK/821/02 (H5N1)) polymerase (PB1) gene, complete cds. |
| AY576398 | Influenza A virus (A/Ck/HK/31.4/02 (H5N1)) polymerase (PB1) gene, partial cds. |
| AY576399 | Influenza A virus (A/Ck/HK/61.9/02 (H5N1)) polymerase (PB1) gene, partial cds. |
| AY576400 | Influenza A virus (A/Ck/HK/YU777/02 (H5N1)) polymerase (PB1) gene, partial cds. |
| AY576401 | Influenza A virus (A/Ck/HK/96.1/02 (H5N1)) polymerase (PB1) gene, partial cds. |
| AY576402 | Influenza A virus (A/Ck/HK/409.1/02 (H5N1)) polymerase (PB1) gene, partial cds. |
| AY576403 | Influenza A virus (A/Ph/HK/674.15/02 (H5N1)) polymerase (PB1) gene, partial cds. |
| AY585483 | Influenza A virus (A/duck/Fujian/01/2002(H5N1)) polymerase basic protein 1 (PB1) mRNA, complete cds. |
| AY585484 | Influenza A virus (A/duck/Fujian/13/2002(H5N1)) polymerase basic protein 1 (PB1) mRNA, complete cds. |

TABLE 6-continued

| | |
|---|---|
| AY585485 | Influenza A virus (A/duck/Fujian/17/2001(H5N1)) polymerase basic protein 1 (PB1) mRNA, complete cds. |
| AY585486 | Influenza A virus (A/duck/Fujian/19/2000(H5N1)) polymerase basic protein 1 (PB1) mRNA, complete cds. |
| AY585487 | Influenza A virus (A/duck/Guangdong/01/2001(H5N1)) polymerase basic protein 1 (PB1) mRNA, complete cds. |
| AY585488 | Influenza A virus (A/duck/Guangdong/07/2000(H5N1)) polymerase basic protein 1 (PB1) mRNA, complete cds. |
| AY585489 | Influenza A virus (A/duck/Guangdong/12/2000(H5N1)) polymerase basic protein 1 (PB1) mRNA, complete cds. |
| AY585490 | Influenza A virus (A/duck/Guangdong/22/2002(H5N1)) polymerase basic protein 1 (PB1) mRNA, complete cds. |
| AY585491 | Influenza A virus (A/duck/Guangdong/40/2000(H5N1)) polymerase basic protein 1 (PB1) mRNA, complete cds. |
| AY585492 | Influenza A virus (A/duck/Guangxi/07/1999(H5N1)) polymerase basic protein 1 (PB1) mRNA, complete cds. |
| AY585493 | Influenza A virus (A/duck/Guangxi/22/2001(H5N1)) polymerase basic protein 1 (PB1) mRNA, complete cds. |
| AY585494 | Influenza A virus (A/duck/Guangxi/35/2001(H5N1)) polymerase basic protein 1 (PB1) mRNA, complete cds. |
| AY585495 | Influenza A virus (A/duck/Guangxi/50/2001(H5N1)) polymerase basic protein 1 (PB1) mRNA, complete cds. |
| AY585496 | Influenza A virus (A/duck/Guangxi/53/2002(H5N1)) polymerase basic protein 1 (PB1) mRNA, complete cds. |
| AY585497 | Influenza A virus (A/duck/Shanghai/08/2001(H5N1)) polymerase basic protein 1 (PB1) mRNA, complete cds. |
| AY585498 | Influenza A virus (A/duck/Shanghai/13/2001(H5N1)) polymerase basic protein 1 (PB1) mRNA, complete cds. |
| AY585499 | Influenza A virus (A/duck/Shanghai/35/2002(H5N1)) polymerase basic protein 1 (PB1) mRNA, complete cds. |
| AY585500 | Influenza A virus (A/duck/Shanghai/37/2002(H5N1)) polymerase basic protein 1 (PB1) mRNA, complete cds. |
| AY585501 | Influenza A virus (A/duck/Shanghai/38/2001(H5N1)) polymerase basic protein 1 (PB1) mRNA, complete cds. |
| AY585502 | Influenza A virus (A/duck/Zhejiang/11/2000(H5N1)) polymerase basic protein 1 (PB1) mRNA, complete cds. |
| AY585503 | Influenza A virus (A/duck/Zhejiang/52/2000(H5N1)) polymerase basic protein 1 (PB1) mRNA, complete cds. |
| AY590582 | Influenza A virus (A/chicken/Nakorn-Patom/Thailand/CU-K2/2004(H5N1)) polymerase basic protein 1 (PBP1) gene, complete cds. |
| AY609310 | Influenza A virus (A/chicken/Guangdong/174/04(H5N1)) segment 2, complete sequence. |
| AY651651 | Influenza A virus (A/Ck/Indonesia/BL/2003(H5N1)) polymerase basic subunit 1 (PB1) gene, partial cds. |
| AY651652 | Influenza A virus (A/Dk/Indonesia/MS/2004(H5N1)) polymerase basic subunit 1 (PB1) gene, partial cds. |
| AY651653 | Influenza A virus (A/Ck/Indonesia/PA/2003(H5N1)) polymerase basic subunit 1 (PB1) gene, partial cds. |
| AY651654 | Influenza A virus (A/Ck/Indonesia/4/2004(H5N1)) polymerase basic subunit 1 (PB1) gene, partial cds. |
| AY651655 | Influenza A virus (A/Ck/Indonesia/2A/2003(H5N1)) polymerase basic subunit 1 (PB1) gene, partial cds. |
| AY651656 | Influenza A virus (A/Ck/Indonesia/5/2004(H5N1)) polymerase basic subunit 1 (PB1) gene, partial cds. |
| AY651657 | Influenza A virus (A/Ck/Thailand/1/2004(H5N1)) polymerase basic subunit 1 (PB1) gene, partial cds. |
| AY651658 | Influenza A virus (A/Ck/Thailand/73/2004(H5N1)) polymerase basic subunit 1 (PB1) gene, partial cds. |
| AY651659 | Influenza A virus (A/Ck/Thailand/9.1/2004(H5N1)) polymerase basic subunit 1 (PB1) gene, partial cds. |
| AY651660 | Influenza A virus (A/Qa/Thailand/57/2004(H5N1)) polymerase basic subunit 1 (PB1) gene, partial cds. |
| AY651661 | Influenza A virus (A/bird/Thailand/3.1/2004(H5N1)) polymerase basic subunit 1 (PB1) gene, partial cds. |
| AY651662 | Influenza A virus (A/Dk/Thailand/71.1/2004(H5N1)) polymerase basic subunit 1 (PB1) gene, partial cds. |
| AY651663 | Influenza A virus (A/Gs/Thailand/79/2004(H5N1)) polymerase basic subunit 1 (PB1) gene, partial cds. |
| AY651668 | Influenza A virus (A/Ck/Viet Nam/33/2004(H5N1)) polymerase basic subunit 1 (PB1) gene, partial cds. |
| AY651669 | Influenza A virus (A/Ck/Viet Nam/35/2004(H5N1)) polymerase basic subunit 1 (PB1) gene, partial cds. |
| AY651670 | Influenza A virus (A/Ck/Viet Nam/36/2004(H5N1)) polymerase basic subunit 1 (PB1) gene, partial cds. |
| AY651671 | Influenza A virus (A/Ck/Viet Nam/37/2004(H5N1)) polymerase basic subunit 1 (PB1) gene, partial cds. |
| AY651672 | Influenza A virus (A/Ck/Viet Nam/38/2004(H5N1)) polymerase basic subunit 1 (PB1) gene, partial cds. |
| AY651673 | Influenza A virus (A/Ck/Viet Nam/39/2004(H5N1)) polymerase basic subunit 1 (PB1) gene, partial cds. |

TABLE 6-continued

| | |
|---|---|
| AY651674 | Influenza A virus (A/Ck/Viet Nam/C57/2004(H5N1)) polymerase basic subunit 1 (PB1) gene, partial cds. |
| AY651675 | Influenza A virus (A/Dk/Viet Nam/11/2004(H5N1)) polymerase basic subunit 1 (PB1) gene, partial cds. |
| AY651676 | Influenza A virus (A/Gf/HK/38/2002(H5N1)) polymerase basic subunit 1 (PB1) gene, partial cds. |
| AY651677 | Influenza A virus (A/Ck/HK/31.2/2002(H5N1)) polymerase basic subunit 1 gene, partial cds. |
| AY651678 | Influenza A virus (A/Ck/HK/37.4/2002(H5N1)) polymerase basic subunit 1 (PB1) gene, partial cds. |
| AY651679 | Influenza A virus (A/SCk/HK/YU100/2002(H5N1)) polymerase basic subunit 1 (PB1) gene, partial cds. |
| AY651680 | Influenza A virus (A/Ck/HK/YU22/2002(H5N1)) polymerase basic subunit 1 (PB1) gene, partial cds. |
| AY651681 | Influenza A virus (A/Ck/HK/3176.3/2002(H5N1)) polymerase basic subunit 1 (PB1) gene, partial cds. |
| AY651682 | Influenza A virus (A/Ck/HK/3169.1/2002(H5N1)) polymerase basic subunit 1 (PB1) gene, partial cds. |
| AY651683 | Influenza A virus (A/Ck/HK/FY157/2003(H5N1)) polymerase basic subunit 1 (PB1) gene, partial cds. |
| AY651684 | Influenza A virus (A/Ck/HK/YU324/2003(H5N1)) polymerase basic subunit 1 (PB1) gene, partial cds. |
| AY651685 | Influenza A virus (A/Ck/HK/2133.1/2003(H5N1)) polymerase basic subunit 1 (PB1) gene, partial cds. |
| AY651686 | Influenza A virus (A/Ck/HK/NT93/2003(H5N1)) polymerase basic subunit 1 (PB1) gene, partial cds. |
| AY651687 | Influenza A virus (A/Ck/HK/SSP141/2003(H5N1)) polymerase basic subunit 1 (PB1) gene, partial cds. |
| AY651688 | Influenza A virus (A/Ck/HK/WF157/2003(H5N1)) polymerase basic subunit 1 (PB1) gene, partial cds. |
| AY651689 | Influenza A virus (A/black headed gull/HK/12.1/2003(H5N1)) polymerase basic subunit 1 (PB1) gene, partial cds. |
| AY651690 | Influenza A virus (A/feral pigeon/HK/862.7/2002(H5N1)) polymerase basic subunit 1 (PB1) gene, partial cds. |
| AY651691 | Influenza A virus (A/grey heron/HK/861.1/2002(H5N1)) polymerase basic subunit 1 (PB1) gene, partial cds. |
| AY651692 | Influenza A virus (A/tree sparrow/HK/864/2002(H5N1)) polymerase basic subunit 1 (PB1) gene, partial cds. |
| AY651693 | Influenza A virus (A/teal/China/2978.1/2002(H5N1)) polymerase basic subunit 1 (PB1) gene, partial cds. |
| AY651694 | Influenza A virus (A/peregrine falcon/HK/D0028/2004(H5N1)) polymerase basic subunit 1 (PB1) gene, partial cds. |
| AY651695 | Influenza A virus (A/Dk/HN/5806/2003(H5N1)) polymerase basic subunit 1 (PB1) gene, partial cds. |
| AY651696 | Influenza A virus (A/Dk/ST/4003/2003(H5N1)) polymerase basic subunit 1 (PB1) gene, partial cds. |
| AY651697 | Influenza A virus (A/Ck/ST/4231/2003(H5N1)) polymerase basic subunit 1 (PB1) gene, partial cds. |
| AY651698 | Influenza A virus (A/Dk/YN/6255/2003(H5N1)) polymerase basic subunit 1 (PB1) gene, partial cds. |
| AY651699 | Influenza A virus (A/Dk/YN/6445/2003(H5N1)) polymerase basic subunit 1 (PB1) gene, partial cds. |
| AY651700 | Influenza A virus (A/Ph/ST/44/2004(H5N1)) polymerase basic subunit 1 (PB1) gene, partial cds. |
| AY651701 | Influenza A virus (A/Dk/HN/303/2004(H5N1)) polymerase basic subunit 1 (PB1) gene, partial cds. |
| AY651702 | Influenza A virus (A/Dk/HN/101/2004(H5N1)) polymerase basic subunit 1 (PB1) gene, partial cds. |
| AY651703 | Influenza A virus (A/Ck/YN/374/2004(H5N1)) polymerase basic subunit 1 (PB1) gene, partial cds. |
| AY651704 | Influenza A virus (A/Ck/YN/115/2004(H5N1)) polymerase basic subunit 1 (PB1) gene, partial cds. |
| AY653199 | Influenza A virus (A/chicken/Jilin/9/2004(H5N1)) segment 2, complete sequence. |
| AY676025 | Influenza A virus strain (A/duck/Hong Kong/821/02(H5N1)) polymerase basic 1 (PB1) gene, complete cds. |
| AY676026 | Influenza A virus strain (A/egret/Hong Kong/757.2/03(H5N1)) polymerase basic 1 (PB1) gene, complete cds. |
| AY676027 | Influenza A virus strain (A/chicken/Korea/ES/03(H5N1)) polymerase basic 1 (PB1) gene, complete cds. |
| AY676028 | Influenza A virus strain (A/duck/Korea/ESD1/03(H5N1)) polymerase basic 1 (PB1) gene, complete cds. |
| AY684704 | Influenza A virus (A/chicken/Hubei/327/2004(H5N1)) polymerase basic protein 1 (PB1) gene, complete cds. |
| AY737287 | Influenza A virus (A/chicken/Guangdong/191/04(H5N1)) segment 2, complete sequence. |
| AY737294 | Influenza A virus (A/chicken/Guangdong/178/04(H5N1)) segment 2, complete sequence. |
| AY737302 | Influenza A virus (A/duck/Guangdong/173/04(H5N1)) segment 2, complete sequence. |

TABLE 6-continued

| | |
|---|---|
| AY770083 | Influenza A virus (A/chicken/Hubei/489/2004(H5N1)) nonfunctional polymerase basic protein 1 (PB1) gene, complete sequence. |
| AY770994 | Influenza A virus (A/chicken/Ayutthaya/Thailand/CU-23/04(H5N1)) polymerase basic protein 1 gene, partial cds. |
| AY818130 | Influenza A virus (A/chicken/Vietnam/C58/04(H5N1)) polymerase protein PB1 gene, complete cds. |
| AY818131 | Influenza A virus (A/quail/Vietnam/36/04(H5N1)) polymerase protein PB1 gene, complete cds. |
| AY856862 | Influenza A virus (A/duck/Shandong/093/2004(H5N1)) segment 2, complete sequence. |
| AB188822 | Influenza A virus (A/chicken/Kyoto/3/2004(H5N1)) PB1 gene for polymerase basic protein 1, complete cds. |
| AB189051 | Influenza A virus (A/crow/Kyoto/53/2004(H5N1)) PB1 gene for polymerase basic protein 1, complete cds,. |
| AB189060 | Influenza A virus (A/crow/Osaka/102/2004(H5N1)) PB1 gene for polymerase basic protein 1, complete cds,. |
| AF046085 | Influenza A virus (A/Chicken/Hong Kong/220/97 (H5N1)) polymerase basic protein 1 (PB1) gene, complete cds. |
| AF098590 | Influenza A virus (A/Chicken/Hong Kong/258/97 (H5N1)) PB1 protein (PB1) gene, partial cds. |
| AF098591 | Influenza A virus (A/Chicken/Hong Kong/y388/97 (H5N1)) PB1 protein (PB1) gene, partial cds. |
| AF098592 | Influenza A virus (A/Chicken/Hong Kong/728/97 (H5N1)) PB1 protein (PB1) gene, partial cds. |
| AF098593 | Influenza A virus (A/Chicken/Hong Kong/786/97 (H5N1)) PB1 protein (PB1) gene, partial cds. |
| AF098594 | Influenza A virus (A/Chicken/Hong Kong/915/97 (H5N1)) PB1 protein (PB1) gene, partial cds. |
| AF098595 | Influenza A virus (A/Duck/Hong Kong/p46/97 (H5N1)) PB1 protein (PB1) gene, partial cds. |
| AF098596 | Influenza A virus (A/Duck/Hong Kong/y283/97 (H5N1)) PB1 protein (PB1) gene, partial cds. |
| AF098598 | Influenza A virus (A/Goose/Hong Kong/w355/97 (H5N1)) PB1 protein (PB1) gene, partial cds. |
| AF144301 | Influenza A virus (A/Goose/Guangdong/1/96(H5N1)) polymerase (PB1) gene, complete cds. |
| AF216716 | Influenza A virus (A/Environment/Hong Kong/437-4/99 (H5N1)) polymerase basic protein 1 gene, complete cds. |
| AF216724 | Influenza A virus (A/Environment/Hong Kong/437-6/99 (H5N1)) polymerase basic protein 1 gene, complete cds. |
| AF216732 | Influenza A virus (A/Environment/Hong Kong/437-8/99 (H5N1)) polymerase basic protein 1 gene, complete cds. |
| AF216740 | Influenza A virus (A/Environment/Hong Kong/437-10/99 (H5N1)) polymerase basic protein 1 gene, complete cds. |
| AY303663 | Influenza A virus (A/chicken/Chile/176822/02(H7N3)) polymerase basic protein 1 gene, complete cds. |
| AY303664 | Influenza A virus (A/chicken/Chile/4957/02(H7N3)) polymerase basic protein 1 gene, partial cds. |
| AY586435 | Influenza A Virus (A/turkey/Italy/214845/02(H7N3)) PB1 gene, partial cds. |
| AY586436 | Influenza A virus (A/turkey/Italy/220158/2002(H7N3)) PB1 gene, partial cds. |
| AY586437 | Influenza A virus (A/mallard/Italy/33/01(H7N3)) PB1 gene, partial cds. |
| AY586438 | Influenza A Virus (A/mallard/Italy/43/01(H7N3)) PB1 gene, partial cds. |
| AY616765 | Influenza A virus (A/chicken/British Columbia/04(H7N3)) PB1 polymerase subunit (PB1) gene, complete cds. |
| AY646084 | Influenza A virus (A/chicken/British Columbia/GSC__human__B/04(H7N3)) polymerase basic protein 1 (PB1) gene, complete cds. |
| AY648293 | Influenza A virus (A/GSC__chicken__B/British Columbia/04(H7N3)) PB1 polymerase subunit (PB1) gene, complete cds. |
| AY653039 | Influenza A virus (A/GSC__chicken/British Columbia/04(H7N3)) PB1 polymerase subunit (PB1) gene, complete cds. |
| AJ620348 | Influenza A virus (A/Chicken/Germany/R28/03(H7N7)) PB1 gene for RNA polymerase, genomic RNA. |
| AY340080 | Influenza A virus (A/Netherlands/124/03(H7N7)) polymerase (PB1) gene, partial cds. |
| AY340081 | Influenza A virus (A/Netherlands/126/03(H7N7)) polymerase (PB1) gene, partial cds. |
| AY340082 | Influenza A virus (A/Netherlands/127/03(H7N7)) polymerase (PB1) gene, partial cds. |
| AY340083 | Influenza A virus (A/Netherlands/219/03(H7N7)) polymerase (PB1) gene, complete cds. |
| AY340084 | Influenza A virus (A/Netherlands/033/03(H7N7)) polymerase (PB1) gene, complete cds. |
| AY340085 | Influenza A virus (A/chicken/Netherlands/1/03(H7N7)) polymerase (PB1) gene, complete cds. |

TABLE 6-continued

| | |
|---|---|
| AB049155 | Influenza A virus (A/parakeet/Chiba/1/97(H9N2)) PB1 gene for polymerase basic protein 1, complete cds. |
| AB049156 | Influenza A virus (A/parakeet/Narita/92A/98(H9N2)) PB1 gene for polymerase basic protein 1, complete cds. |
| AF508618 | Influenza A virus (A/Ostrich/South Africa/9508103/95(H9N2)) segment 2 polymerase PB1 (PB1) gene, partial cds. |
| AF508619 | Influenza A virus (A/Chicken/Pakistan/4/99(H9N2)) segment 2 polymerase PB1 (PB1) gene, partial cds. |
| AF508620 | Influenza A virus (A/Chicken/Pakistan/5/99(H9N2)) segment 2 polymerase PB1 (PB1) gene, partial cds. |
| AF508621 | Influenza A virus (A/Chicken/Germany/R45/98(H9N2)) segment 2 polymerase PB1 (PB1) gene, partial cds. |
| AF508622 | Influenza A virus (A/Duck/Germany/113/95(H9N2)) segment 2 polymerase PB1 (PB1) gene, partial cds. |
| AF508623 | Influenza A virus (A/Chicken/Iran/11T/99(H9N2)) segment 2 polymerase PB1 (PB1) gene, partial cds. |
| AF508624 | Influenza A virus (A/Chicken/Saudi Arabia/532/99(H9N2)) segment 2 polymerase PB1 (PB1) gene, partial cds. |
| AF508625 | Influenza A virus (A/Pheasant/Ireland/PV18/97(H9N2)) segment 2 polymerase PB1 (PB1) gene, partial cds. |
| AF508626 | Influenza A virus (A/Chicken/Korea/99029/99(H9N2)) segment 2 polymerase PB1 (PB1) gene, partial cds. |
| AF508627 | Influenza A virus (A/Chicken/Beijing/8/98(H9N2)) segment 2 polymerase PB1 (PB1) gene, complete cds. |
| AF508628 | Influenza A virus (A/Chicken/Guangdong/10/00(H9N2)) segment 2 polymerase PB1 (PB1) gene, partial cds. |
| AF508629 | Influenza A virus (A/Chicken/Guangdong/11/97(H9N2)) segment 2 polymerase PB1 (PB1) gene, complete cds. |
| AF508630 | Influenza A virus (A/Chicken/Hebei/4/98(H9N2)) segment 2 polymerase PB1 (PB1) gene, complete cds. |
| AF508631 | Influenza A virus (A/Chicken/Heilongjiang/10/97(H9N2)) segment 2 polymerase PB1 (PB1) gene, partial cds. |
| AF508632 | Influenza A virus (A/Chicken/Henan/62/00(H9N2)) segment 2 polymerase PB1 (PB1) gene, complete cds. |
| AF508633 | Influenza A virus (A/Chicken/Ningxia/5/99(H9N2)) segment 2 polymerase PB1 (PB1) gene, complete cds. |
| AF508634 | Influenza A virus (A/Chicken/Sichuan/5/97(H9N2)) segment 2 polymerase PB1 (PB1) gene, partial cds. |
| AF508635 | Influenza A virus (A/Chicken/Shandong/6/96(H9N2)) segment 2 polymerase PB1 (PB1) gene, partial cds. |
| AF508636 | Influenza A virus (A/Chicken/Shijiazhuang/2/99(H9N2)) segment 2 polymerase PB1 (PB1) gene, complete cds. |
| AF508637 | Influenza A virus (A/Chicken/Shenzhen/9/97(H9N2)) segment 2 polymerase PB1 (PB1) gene, complete cds. |
| AF508638 | Influenza A virus (A/Duck/Nanjing/1/97(H9N2)) segment 2 polymerase PB1 (PB1) gene, complete cds. |
| AF508639 | Influenza A virus (A/Quail/Shanghai/8/96(H9N2)) segment 2 polymerase PB1 (PB1) gene, complete cds. |
| AF523427 | Influenza A virus (A/Duck/Shantou/830/00(H9N2)) polymerase (PB1) gene, partial cds. |
| AF523428 | Influenza A virus (A/Duck/Shantou/2102/00(H9N2)) polymerase (PB1) gene, partial cds. |
| AF523429 | Influenza A virus (A/Duck/Shantou/1043/00(H9N2)) polymerase (PB1) gene, partial cds. |
| AF523430 | Influenza A virus (A/Duck/Shantou/2134/00(H9N2)) polymerase (PB1) gene, partial cds. |
| AF523431 | Influenza A virus (A/Wild Duck/Shantou/4808/01(H9N2)) polymerase (PB1) gene, partial cds. |
| AF523432 | Influenza A virus (A/Duck/Shantou/2144/00(H9N2)) polymerase (PB1) gene, partial cds. |
| AF523433 | Influenza A virus (A/Duck/Shantou/2143/00(H9N2)) polymerase (PB1) gene, partial cds. |
| AF523434 | Influenza A virus (A/Duck/Shantou/1796/00(H9N2)) polymerase (PB1) gene, partial cds. |
| AF523435 | Influenza A virus (A/Duck/Shantou/2088/01(H9N2)) polymerase (PB1) gene, partial cds. |
| AF523436 | Influenza A virus (A/Duck/Shantou/1881/00(H9N2)) polymerase (PB1) gene, partial cds. |
| AF523437 | Influenza A virus (A/Duck/Hong Kong/366/78(H9N2)) polymerase (PB1) gene, partial cds. |
| AF523438 | Influenza A virus (A/Duck/Hong Kong/552/79(H9N2)) polymerase (PB1) gene, partial cds. |
| AF523439 | Influenza A virus (A/Duck/Hong Kong/86/76(H9N2)) polymerase (PB1) gene, partial cds. |
| AF523440 | Influenza A virus (A/Duck/Hong Kong/289/78(H9N2)) polymerase (PB1) gene, partial cds. |
| AF523441 | Influenza A virus (A/Duck/Hong Kong/610/79(H9N2)) polymerase (PB1) gene, partial cds. |
| AF523442 | Influenza A virus (A/Duck/Shantou/1605/01(H9N2)) polymerase (PB1) gene, partial cds. |

TABLE 6-continued

| | |
|---|---|
| AF523443 | Influenza A virus (A/Duck/Shantou/1042/00(H9N2)) polymerase (PB1) gene, partial cds. |
| AF536659 | Influenza A virus (A/Chicken/Beijing/1/95(H9N2)) PB1 gene, partial cds. |
| AF536660 | Influenza A virus (A/Chicken/Beijing/2/97(H9N2)) PB1 gene, partial cds. |
| AF536661 | Influenza A virus (A/Chicken/Beijing/3/99(H9N2)) PB1 gene, partial cds. |
| AF536662 | Influenza A virus (A/Chicken/Guangdong/97(H9N2)) PB1 gene, partial cds. |
| AF536663 | Influenza A virus (A/Chicken/Hebei/1/96(H9N2)) PB1 gene, partial cds. |
| AF536664 | Influenza A virus (A/Chicken/Hebei/2/98(H9N2)) PB1 gene, partial cds. |
| AF536665 | Influenza A virus (A/Chicken/Hebei/3/98(H9N2)) PB1 gene, partial cds. |
| AF536666 | Influenza A virus (A/Chicken/Henan/98(H9N2)) PB1 gene, partial cds. |
| AF536667 | Influenza A virus (A/Chicken/Liaoning/99(H9N2)) PB1 gene, partial cds. |
| AF536668 | Influenza A virus (A/Chicken/Shandong/98(H9N2)) PB1 gene, partial cds. |
| AJ291396 | Influenza A virus (A/Chicken/Pakistan/2/99 (H9N2)) PB1 gene for polymerase PB1, genomic RNA. |
| AJ427862 | Influenza A virus (A/quail/Hong Kong/FY298/00 (H9N2)) partial pb1 gene for PB1 polymerase protein, genomic RNA |
| AY180840 | Influenza A virus strain A/Pigeon/Nanchang/7-058/2000 (H9N2) polymerase subunit PB1 (PB1) gene, partial cds. |
| AY180843 | Influenza A virus strain A/Quail/Nanchang/2-0460/2000 (H9N2) polymerase subunit PB1 (PB1) gene, partial cds. |
| AY180844 | Influenza A virus strain A/Pigeon/Nanchang/2-0461/2000 (H9N2) polymerase subunit PB1 (PB1) gene, partial cds. |
| AY180851 | Influenza A virus strain A/Pigeon/Nanchang/11-145/2000 (H9N2) polymerase subunit PB1 (PB1) gene, partial cds. |
| AY180852 | Influenza A virus strain A/Duck/Nanchang/11-197/2000 (H9N2) polymerase subunit PB1 (PB1) gene, partial cds. |
| AY180854 | Influenza A virus strain A/Duck/Nanchang/11-290/2000 (H9N2) polymerase subunit PB1 (PB1) gene, partial cds. |
| AY180856 | Influenza A virus strain A/Duck/Nanchang/1-0070/2000 (H9N2) polymerase subunit PB1 (PB1) gene, partial cds. |
| AY180866 | Influenza A virus strain A/Duck/Nanchang/7-092/2000 (H9N2) polymerase subunit PB1 (PB1) gene, partial cds. |
| AY180867 | Influenza A virus strain A/Chicken/Nanchang/1-0016/2000 (H9N2) polymerase subunit PB1 (PB1) gene, partial cds. |
| AY180873 | Influenza A virus strain A/Chicken/Nanchang/4-010/2000 (H9N2) polymerase subunit PB1 (PB1) gene, partial cds. |
| AY180874 | Influenza A virus strain A/Chicken/Nanchang/4-301/2001 (H9N2) polymerase subunit PB1 (PB1) gene, partial cds. |
| AY180875 | Influenza A virus strain A/Chicken/Nanchang/4-361/2001 (H9N2) polymerase subunit PB1 (PB1) gene, partial cds. |
| AY180892 | Influenza A virus strain A/Quail/Nanchang/4-040/2000 (H9N2) polymerase subunit PB1 (PB1) gene, partial cds. |
| AY180897 | Influenza A virus strain A/Wild Duck/Nanchang/2-0480/2000 (H9N2) polymerase subunit PB1 (PB1) gene, partial cds. |
| AY180900 | Influenza A virus strain A/Duck/Nanchang/10-389/2000 (H9N2) polymerase subunit PB1 (PB1) gene, partial cds. |
| AY180901 | Influenza A virus strain A/Duck/Nanchang/11-392/2000 (H9N2) polymerase subunit PB1 (PB1) gene, partial cds. |
| AY253751 | Influenza A virus (A/Chicken/Shanghai/F/98(H9N2)) polymerase basic protein 1 (PB1) gene, complete cds. |
| AY307947 | Influenza A virus (A/chicken/Beijing/1/00(H9N2)) polymerase subunit (PB1) gene, partial cds. |
| AY307948 | Influenza A virus (A/chicken/Hebei/1/01(H9N2)) polymerase subunit (PB1) gene, partial cds. |
| AY633170 | Influenza A virus (A/mallard/Alberta/17/91(H9N2)) RNA-directed RNA polymerase subunit P1 (PB1) gene, partial cds. |
| AY633282 | Influenza A virus (A/mallard/Alberta/321/88(H9N2)) RNA-directed RNA polymerase subunit P1 (PB1) gene, partial cds. |
| AY633298 | Influenza A virus (A/mallard/Alberta/11/91(H9N2)) RNA-directed RNA polymerase subunit P1 (PB1) gene, partial cds. |
| AY664774 | Influenza A virus (A/chicken/HongKong/CSW153/03(H9N2)) polymerase basic protein 1 (PB1) gene, partial cds. |
| AY664775 | Influenza A virus (A/chicken/HongKong/AP45/03(H9N2)) polymerase basic protein 1 (PB1) gene, partial cds. |
| AY664776 | Influenza A virus (A/chicken/HongKong/BD90/03(H9N2)) polymerase basic protein 1 (PB1) gene, partial cds. |
| AY664777 | Influenza A virus (A/chicken/HongKong/CSW291/03(H9N2)) polymerase basic protein 1 (PB1) gene, partial cds. |
| AY664778 | Influenza A virus (A/chicken/HongKong/CSW304/03(H9N2)) polymerase basic protein 1 (PB1) gene, partial cds. |

TABLE 6-continued

| | |
|---|---|
| AY664779 | Influenza A virus (A/chicken/HongKong/FY23/03(H9N2)) polymerase basic protein 1 (PB1) gene, partial cds. |
| AY664780 | Influenza A virus (A/guineafowl/HongKong/NT101/03(H9N2)) polymerase basic protein 1 (PB1) gene, partial cds. |
| AY664781 | Influenza A virus (A/chicken/HongKong/NT142/03(H9N2)) polymerase basic protein 1 (PB1) gene, partial cds. |
| AY664782 | Influenza A virus (A/chicken/HongKong/SF1/03(H9N2)) polymerase basic protein 1 (PB1) gene, partial cds. |
| AY664783 | Influenza A virus (A/chicken/HongKong/SSP101/03(H9N2)) polymerase basic protein 1 (PB1) gene, partial cds. |
| AY664784 | Influenza A virus (A/chicken/HongKong/TP38/03(H9N2)) polymerase basic protein 1 (PB1) gene, partial cds. |
| AY664785 | Influenza A virus (A/chicken/HongKong/WF126/03(H9N2)) polymerase basic protein 1 (PB1) gene, partial cds. |
| AY664786 | Influenza A virus (A/pigeon/HongKong/WF53/03(H9N2)) polymerase basic protein 1 (PB1) gene, partial cds. |
| AY664787 | Influenza A virus (A/pheasant/HongKong/WF54/03(H9N2)) polymerase basic protein 1 (PB1) gene, partial cds. |
| AY664788 | Influenza A virus (A/guineafowl/HongKong/NT184/03(H9N2)) polymerase basic protein 1 (PB1) gene, partial cds. |
| AY664789 | Influenza A virus (A/chicken/HongKong/WF120/03(H9N2)) polymerase basic protein 1 (PB1) gene, partial cds. |
| AY664790 | Influenza A virus (A/chicken/HongKong/NT366/03(H9N2)) polymerase basic protein 1 (PB1) gene, partial cds. |
| AY664791 | Influenza A virus (A/chicken/HongKong/YU427/03(H9N2)) polymerase basic protein 1 (PB1) gene, partial cds. |
| AY800239 | Influenza A virus (A/chicken/Korea/S1/2003(H9N2)) polymerase basic protein 1 (PB1) gene, partial cds. |
| AY862694 | Influenza A virus (A/silky chicken/Korea/S3/03(H9N2)) PB1 (PB1) gene, partial cds. |
| AY862695 | Influenza A virus (A/chicken/Korea/S4/03(H9N2)) PB1 (PB1) gene, partial cds. |
| AY862696 | Influenza A virus (A/chicken/Korea/S5/03(H9N2)) PB1 (PB1) gene, partial cds. |
| AY862697 | Influenza A virus (A/chicken/Korea/S12/03(H9N2)) PB1 (PB1) gene, partial cds. |
| AY862698 | Influenza A virus (A/duck/Korea/S13/03(H9N2)) PB1 (PB1) gene, partial cds. |
| AY862699 | Influenza A virus (A/dove/Korea/S14/03(H9N2)) PB1 (PB1) gene, partial cds. |
| AY862700 | Influenza A virus (A/chicken/Korea/S15/03(H9N2)) PB1 (PB1) gene, partial cds. |
| AY862701 | Influenza A virus (A/chicken/Korea/S16/03(H9N2)) PB1 (PB1) gene, partial cds. |
| AY862702 | Influenza A virus (A/chicken/Korea/S18/03(H9N2)) PB1 (PB1) gene, partial cds. |
| AF156416 | Influenza A virus (A/Chicken/Hong Kong/G9/97(H9N2)) segment 2 PB1 polymerase subunit (PB1) gene, partial cds. |
| AF156417 | Influenza A virus (A/Chicken/Hong Kong/G23/99 (H9N2)) segment 2 PB1 polymerase subunit (PB1) gene, partial cds. |
| AF156418 | Influenza A virus (A/Pigeon/Hong Kong/Y233/97(H9N2)) segment 2 PB1 polymerase subunit (PB1) gene, partial cds. |
| AF156419 | Influenza A virus (A/Duck/Hong Kong/Y280/97(H9N2)) segment 2 PB1 polymerase subunit (PB1) gene, partial cds. |
| AF156420 | Influenza A virus (A/Duck/Hong Kong/Y439/97(H9N2)) segment 2 PB1 polymerase subunit (PB1) gene, partial cds. |
| AF156421 | Influenza A virus (A/Quail/Hong Kong/G1/97 (H9N2)) segment 2 PB1 polymerase subunit (PB1) gene, partial cds. |
| AF156422 | Influenza A virus (A/Chicken/Hong Kong/739/94(H9N2)) segment 2 PB1 polymerase subunit (PB1) gene, partial cds. |
| AF156423 | Influenza A virus (A/Chicken/Beijing/1/94(H9N2)) segment 2 PB1 polymerase subunit (PB1) gene, partial cds. |
| AF156424 | Influenza A virus (A/Quail/Hong Kong/AF157/92(H9N2)) segment 2 PB1 polymerase subunit (PB1) gene, partial cds. |
| AF156425 | Influenza A virus (A/Chicken/Korea/38349-p96323/96(H9N2)) segment 2 PB1 polymerase subunit (PB1) gene, partial cds. |
| AF156426 | Influenza A virus (A/Chicken/Korea/25232-96006/96(H9N2)) segment 2 PB1 polymerase subunit (PB1) gene, partial cds. |
| AF156427 | Influenza A virus (A/Shorebird/Delaware/9/96(H9N2)) segment 2 PB1 polymerase subunit (PB1) gene, partial cds. |
| AF156428 | Influenza A virus (A/Quail/Arkansas/29209-1/93(H9N2)) segment 2 PB1 polymerase subunit (PB1) gene, partial cds. |
| AF156429 | Influenza A virus (A/Turkey/California/189/66(H9N2)) segment 2 PB1 polymerase subunit (PB1) gene, partial cds. |
| AF222632 | Influenza A virus (A/Quail/Hong Kong/A17/99(H9N2)) segment 2 polymerase 1 (PB1) gene, partial cds. |
| AF222633 | Influenza A virus (A/Pigeon/Hong Kong/FY6/99(H9N2)) segment 2 polymerase 1 (PB1) gene, partial cds. |
| AF222634 | Influenza A virus (A/Chicken/Hong Kong/NT16/99(H9N2)) segment 2 polymerase 1 (PB1) gene, partial cds. |

TABLE 6-continued

| | |
|---|---|
| AF222635 | Influenza A virus (A/Quail/Hong Kong/SSP10/99(H9N2)) segment 2 polymerase 1 (PB1) gene, partial cds. |
| AF222636 | Influenza A virus (A/Pheasant/Hong Kong/SSP11/99(H9N2)) segment 2 polymerase 1 (PB1) gene, partial cds. |
| AF222637 | Influenza A virus (A/Chicken/Hong Kong/FY20/99(H9N2)) segment 2 polymerase 1 (PB1) gene, partial cds. |
| AF222638 | Influenza A virus (A/Chicken/Hong Kong/KC12/99(H9N2)) segment 2 polymerase 1 (PB1) gene, partial cds. |
| AF222639 | Influenza A virus (A/Quail/Hong Kong/NT2899(H9N2)) segment 2 polymerase 1 (PB1) gene, partial cds. |
| AF222640 | Influenza A virus (A/Chicken/Hong Kong/SF2/99(H9N2)) segment 2 polymerase 1 (PB1) gene, partial cds. |
| AF222641 | Influenza A virus (A/Silky Chicken/Hong Kong/SF44/99(H9N2)) segment 2 polymerase 1 (PB1) gene, partial cds. |
| Sequences used in analysis of Influenza A Polymerase Basic protein 2 (PB2) | |
| gi\|49356919\|AY633219\| | Influenza A virus (A/mallard/Alberta/211/98(H1N1)) polymerase basic protein 2 (PB2) gene, partial cds. |
| gi\|27466107\|AY180748\| | Influenza A virus strain A/Quail/Nanchang/12-340/2000 (H1N1) polymerase subunit PB2 (PB2) gene, partial cds. |
| gi\|45272173\|AY422042\| | Influenza A virus (A/duck/Hokkaido/95/01(H2N2)) polymerase subunit (PB2) gene, partial cds. |
| gi\|18091825\|AF213910\| | Influenza A virus (A/Chicken/Italy/5945/95(H3N2)) segment 1 PB2 polymerase protein gene, partial cds. |
| gi\|27466133\|AY180761\| | Influenza A virus strain A/Chicken/Nanchang/3-120/2001 (H3N2) polymerase subunit PB2 (PB2) gene, partial cds. |
| gi\|56160002\|AY779267\| | Influenza A virus (A/turkey/North Carolina/12344/03(H3N2)) polymerase basic protein 2 (PB2) gene, partial cds. |
| gi\|56160004\|AY779268\| | Influenza A virus (A/turkey/Minnesota/764-2/03(H3N2)) polymerase basic protein 2 (PB2) gene, partial cds. |
| gi\|58429704\|AY862719\| | Influenza A virus (A/chicken/Korea/S6/03(H3N2)) PB2 (PB2) gene, partial cds. |
| gi\|58429706\|AY862720\| | Influenza A virus (A/duck/Korea/S7/03(H3N2)) PB2 (PB2) gene, partial cds. |
| gi\|58429708\|AY862721\| | Influenza A virus (A/duck/Korea/S8/03(H3N2)) PB2 (PB2) gene, partial cds. |
| gi\|58429710\|AY862722\| | Influenza A virus (A/duck/Korea/S9/03(H3N2)) PB2 (PB2) gene, partial cds. |
| gi\|58429712\|AY862723\| | Influenza A virus (A/duck/Korea/S10/03(H3N2)) PB2 (PB2) gene, partial cds. |
| gi\|58429714\|AY862724\| | Influenza A virus (A/dove/Korea/S11/03(H3N2)) PB2 (PB2) gene, partial cds. |
| gi\|5805276\|AF144300\| | Influenza A virus (A/Goose/Guangdong/1/96(H5N1)) polymerase (PB2) gene, complete cds. |
| gi\|3335416\|AF046086\| | Influenza A virus (A/Chicken/Hong Kong/220/97 (H5N1)) polymerase basic protein 2 (PB2) gene, partial cds. |
| gi\|6048841\|AF098577\| | Influenza A virus (A/Chicken/Hong Kong/258/97 (H5N1)) PB2 protein (PB2) gene, partial cds. |
| gi\|6048843\|AF098578\| | Influenza A virus (A/Chicken/Hong Kong/y388/97 (H5N1)) PB2 protein (PB2) gene, partial cds. |
| gi\|6048845\|AF098579\| | Influenza A virus (A/Chicken/Hong Kong/728/97 (H5N1)) PB2 protein (PB2) gene, partial cds. |
| gi\|6048847\|AF098580\| | Influenza A virus (A/Chicken/Hong Kong/786/97 (H5N1)) PB2 protein (PB2) gene, partial cds. |
| gi\|6048849\|AF098581\| | Influenza A virus (A/Chicken/Hong Kong/915/97 (H5N1)) PB2 protein (PB2) gene, partial cds. |
| gi\|6048851\|AF098582\| | Influenza A virus (A/Duck/Hong Kong/p46/97 (H5N1)) PB2 protein (PB2) gene, partial cds. |
| gi\|6048853\|AF098583\| | Influenza A virus (A/Duck/Hong Kong/y283/97 (H5N1)) PB2 protein (PB2) gene, partial cds. |
| gi\|6048855\|AF098584\| | Influenza A virus (A/Goose/Hong Kong/w355/97 (H5N1)) PB2 protein (PB2) gene, partial cds. |
| gi\|14860983\|AY038798\| | Influenza A virus (A/goose/Guangdong/3/1997(H5N1)) PB2 protein (PB2) gene, complete cds. |
| gi\|47156244\|AY585513\| | Influenza A virus (A/duck/Guangxi/07/1999(H5N1)) polymerase basic protein 2 (PB2) mRNA, complete cds. |
| gi\|9863884\|AF216717\| | Influenza A virus (A/Environment/Hong Kong/437-4/99 (H5N1)) polymerase basic protein 2 gene, partial cds. |
| gi\|9863903\|AF216725\| | Influenza A virus (A/Environment/Hong Kong/437-6/99 (H5N1)) polymerase basic protein 2 gene, partial cds. |
| gi\|9863921\|AF216733\| | Influenza A virus (A/Environment/Hong Kong/437-8/99 (H5N1)) polymerase basic protein 2 gene, partial cds. |
| gi\|9863939\|AF216741\| | Influenza A virus (A/Environment/Hong Kong/437-10/99 (H5N1)) polymerase basic protein 2 gene, partial cds. |
| gi\|47156264\|AY585523\| | Influenza A virus (A/duck/Zhejiang/11/2000(H5N1)) polymerase basic protein 2 (PB2) mRNA, complete cds. |
| gi\|47156266\|AY585524\| | Influenza A virus (A/duck/Zhejiang/52/2000(H5N1)) polymerase basic protein 2 (PB2) mRNA, complete cds. |

TABLE 6-continued

| | |
|---|---|
| gi\|47156232\|AY585507\| | Influenza A virus (A/duck/Fujian/19/2000(H5N1)) polymerase basic protein 2 (PB2) mRNA, complete cds. |
| gi\|47156236\|AY585509\| | Influenza A virus (A/duck/Guangdong/07/2000(H5N1)) polymerase basic protein 2 (PB2) mRNA, complete cds. |
| gi\|47156238\|AY585510\| | Influenza A virus (A/duck/Guangdong/12/2000(H5N1)) polymerase basic protein 2 (PB2) mRNA, complete cds. |
| gi\|47156242\|AY585512\| | Influenza A virus (A/duck/Guangdong/40/2000(H5N1)) polymerase basic protein 2 (PB2) mRNA, complete cds. |
| gi\|19697849\|AY059520\| | Influenza A virus (A/Goose/Hong Kong/ww26/2000(H5N1)) segment 1 polymerase (PB2) gene, partial cds. |
| gi\|19697851\|AY059521\| | Influenza A virus (A/Goose/Hong Kong/ww28/2000(H5N1)) segment 1 polymerase (PB2) gene, partial cds. |
| gi\|19697853\|AY059522\| | Influenza A virus (A/Duck/Hong Kong/ww381/2000(H5N1)) segment 1 polymerase (PB2) gene, partial cds. |
| gi\|19697855\|AY059523\| | Influenza A virus (A/Duck/Hong Kong/ww461/2000(H5N1)) segment 1 polymerase (PB2) gene, partial cds. |
| gi\|19697857\|AY059524\| | Influenza A virus (A/Goose/Hong Kong/ww491/2000(H5N1)) segment 1 polymerase (PB2) gene, partial cds. |
| gi\|19697859\|AY059525\| | Influenza A virus (A/Duck/Hong Kong/2986.1/2000(H5N1)) segment 1 polymerase (PB2) gene, partial cds. |
| gi\|19697867\|AY059529\| | Influenza A virus (A/Goose/Hong Kong/3014.8/2000(H5N1)) segment 1 polymerase (PB2) gene, partial cds. |
| gi\|18092181\|AF398425\| | Influenza A virus (A/Goose/Hong Kong/385.3/2000(H5N1)) polymerase (PB2) gene, partial cds. |
| gi\|18092183\|AF398426\| | Influenza A virus (A/Goose/Hong Kong/385.5/2000(H5N1)) polymerase (PB2) gene, partial cds. |
| gi\|21359665\|AF468840\| | Influenza A virus (A/Duck/Anyang/AVL-1/2001(H5N1)) polymerase basic protein 2 (PB2) gene, partial cds. |
| gi\|28849606\|AF509143\| | Influenza A virus (A/Chicken/Hong Kong/FY77/01 (H5N1)) polymerase (PB2) gene, partial cds. |
| gi\|28849608\|AF509144\| | Influenza A virus (A/Chicken/Hong Kong/YU562/01 (H5N1)) polymerase (PB2) gene, partial cds. |
| gi\|28849610\|AF509145\| | Influenza A virus (A/Chicken/Hong Kong/YU563/01 (H5N1)) polymerase (PB2) gene, partial cds. |
| gi\|28849612\|AF509146\| | Influenza A virus (A/Chicken/Hong Kong/FY150/01 (H5N1)) polymerase (PB2) gene, partial cds. |
| gi\|28849614\|AF509147\| | Influenza A virus (A/Pheasant/Hong Kong/FY155/01 (H5N1)) polymerase (PB2) gene, partial cds. |
| gi\|28849616\|AF509148\| | Influenza A virus (A/Silky Chicken/Hong Kong/SF189/01 (H5N1)) polymerase (PB2) gene, partial cds. |
| gi\|28849618\|AF509149\| | Influenza A virus (A/Quail/Hong Kong/SF203/01 (H5N1)) polymerase (PB2) gene, partial cds. |
| gi\|28849620\|AF509150\| | Influenza A virus (A/Pigeon/Hong Kong/SF215/01 (H5N1)) polymerase (PB2) gene, partial cds. |
| gi\|28849622\|AF509151\| | Influenza A virus (A/Chicken/Hong Kong/SF219/01 (H5N1)) polymerase (PB2) gene, partial cds. |
| gi\|28849624\|AF509152\| | Influenza A virus (A/Chicken/Hong Kong/715.5/01 (H5N1)) polymerase (PB2) gene, partial cds. |
| gi\|28849626\|AF509153\| | Influenza A virus (A/Chicken/Hong Kong/751.1/01 (H5N1)) polymerase (PB2) gene, partial cds. |
| gi\|28849628\|AF509154\| | Influenza A virus (A/Chicken/Hong Kong/822.1/01 (H5N1)) polymerase (PB2) gene, partial cds. |
| gi\|28849630\|AF509155\| | Influenza A virus (A/Chicken/Hong Kong/829.2/01 (H5N1)) polymerase (PB2) gene, partial cds. |
| gi\|28849632\|AF509156\| | Influenza A virus (A/Chicken/Hong Kong/830.2/01 (H5N1)) polymerase (PB2) gene, partial cds. |
| gi\|28849634\|AF509157\| | Influenza A virus (A/Chicken/Hong Kong/858.3/01 (H5N1)) polymerase (PB2) gene, partial cds. |
| gi\|28849636\|AF509158\| | Influenza A virus (A/Chicken/Hong Kong/866.3/01 (H5N1)) polymerase (PB2) gene, partial cds. |
| gi\|28849638\|AF509159\| | Influenza A virus (A/Chicken/Hong Kong/867.1/01 (H5N1)) polymerase (PB2) gene, partial cds. |
| gi\|28849640\|AF509160\| | Influenza A virus (A/Chicken/Hong Kong/879.1/01 (H5N1)) polymerase (PB2) gene, partial cds. |
| gi\|28849642\|AF509161\| | Influenza A virus (A/Chicken/Hong Kong/873.3/01 (H5N1)) polymerase (PB2) gene, partial cds. |
| gi\|28849644\|AF509162\| | Influenza A virus (A/Chicken/Hong Kong/876.1/01 (H5N1)) polymerase (PB2) gene, partial cds. |
| gi\|28849646\|AF509163\| | Influenza A virus (A/Chicken/Hong Kong/891.1/01 (H5N1)) polymerase (PB2) gene, partial cds. |
| gi\|28849648\|AF509164\| | Influenza A virus (A/Chicken/Hong Kong/893.2/01 (H5N1)) polymerase (PB2) gene, partial cds. |
| gi\|28849650\|AF509165\| | Influenza A virus (A/Goose/Hong Kong/76.1/01 (H5N1)) polymerase (PB2) gene, partial cds. |
| gi\|28849652\|AF509166\| | Influenza A virus (A/Goose/Hong Kong/ww100/01 (H5N1)) polymerase (PB2) gene, partial cds. |
| gi\|28849654\|AF509167\| | Influenza A virus (A/Duck/Hong Kong/573.4/01 (H5N1)) polymerase (PB2) gene, partial cds. |
| gi\|28849656\|AF509168\| | Influenza A virus (A/Duck/Hong Kong/646.3/01 (H5N1)) polymerase (PB2) gene, partial cds. |

TABLE 6-continued

| | |
|---|---|
| gi\|28823262\|AY221584\| | Influenza A virus (A/Chicken/HongKong/NT873.3/01-MB(H5N1)) polymerase basic protein 2 (PB2) gene, partial cds. |
| gi\|28823443\|AY221585\| | Influenza A virus (A/Chicken/HongKong/NT873.3/01(H5N1)) polymerase basic protein 2 (PB2) gene, partial cds. |
| gi\|28823612\|AY221586\| | Influenza A virus (A/Chicken/HongKong/FY150/01-MB(H5N1)) polymerase basic protein 2 (PB2) gene, partial cds. |
| gi\|28823783\|AY221587\| | Influenza A virus (A/Chicken/HongKong/FY150/01(H5N1)) polymerase basic protein 2 (PB2) gene, partial cds. |
| gi\|28823961\|AY221588\| | Influenza A virus (A/Pheasant/HongKong/FY155/01-MB(H5N1)) polymerase basic protein 2 (PB2) gene, partial cds. |
| gi\|28824143\|AY221589\| | Influenza A virus (A/Pheasant/HongKong/FY155/01(H5N1)) polymerase basic protein 2 (PB2) gene, partial cds. |
| gi\|28824334\|AY221590\| | Influenza A virus (A/Chicken/HongKong/YU822.2/01-MB(H5N1)) polymerase basic protein 2 (PB2) gene, partial cds. |
| gi\|28824502\|AY221591\| | Influenza A virus (A/Chicken/HongKong/YU822.2/01(H5N1)) polymerase basic protein 2 (PB2) gene, partial cds. |
| gi\|28824684\|AY221592\| | Influenza A virus (A/Chicken/HongKong/YU562/01(H5N1)) polymerase basic protein 2 (PB2) gene, partial cds. |
| gi\|47156230\|AY585506\| | Influenza A virus (A/duck/Fujian/17/2001(H5N1)) polymerase basic protein 2 (PB2) mRNA, complete cds. |
| gi\|47156234\|AY585508\| | Influenza A virus (A/duck/Guangdong/01/2001(H5N1)) polymerase basic protein 2 (PB2) mRNA, complete cds. |
| gi\|47156246\|AY585514\| | Influenza A virus (A/duck/Guangxi/22/2001(H5N1)) polymerase basic protein 2 (PB2) mRNA, complete cds. |
| gi\|47156248\|AY585515\| | Influenza A virus (A/duck/Guangxi/35/2001(H5N1)) polymerase basic protein 2 (PB2) mRNA, complete cds. |
| gi\|47156250\|AY585516\| | Influenza A virus (A/duck/Guangxi/50/2001(H5N1)) polymerase basic protein 2 (PB2) mRNA, complete cds. |
| gi\|47156254\|AY585518\| | Influenza A virus (A/duck/Shanghai/08/2001(H5N1)) polymerase basic protein 2 (PB2) mRNA, complete cds. |
| gi\|47156256\|AY585519\| | Influenza A virus (A/duck/Shanghai/13/2001(H5N1)) polymerase basic protein 2 (PB2) mRNA, complete cds. |
| gi\|47156262\|AY585522\| | Influenza A virus (A/duck/Shanghai/38/2001(H5N1)) polymerase basic protein 2 (PB2) mRNA, complete cds. |
| gi\|47156258\|AY585520\| | Influenza A virus (A/duck/Shanghai/35/2002(H5N1)) polymerase basic protein 2 (PB2) mRNA, complete cds. |
| gi\|47156260\|AY585521\| | Influenza A virus (A/duck/Shanghai/37/2002(H5N1)) polymerase basic protein 2 (PB2) mRNA, complete cds. |
| gi\|47156252\|AY585517\| | Influenza A virus (A/duck/Guangxi/53/2002(H5N1)) polymerase basic protein 2 (PB2) mRNA, complete cds. |
| gi\|47156240\|AY585511\| | Influenza A virus (A/duck/Guangdong/22/2002(H5N1)) polymerase basic protein 2 (PB2) mRNA, complete cds. |
| gi\|47834791\|AY576382\| | Influenza A virus (A/Gs/HK/739.2/02 (H5N1)) polymerase (PB2) gene, partial cds. |
| gi\|47834793\|AY576383\| | Influenza A virus (A/Eg/HK/757.3/02 (H5N1)) polymerase (PB2) gene, partial cds. |
| gi\|47834795\|AY576384\| | Influenza A virus (A/G.H/HK/793.1/02 (H5N1)) polymerase (PB2) gene, partial cds. |
| gi\|47834797\|AY576385\| | Influenza A virus (A/Dk/HK/821/02 (H5N1)) polymerase (PB2) gene, partial cds. |
| gi\|47834799\|AY576386\| | Influenza A virus (A/Ck/HK/31.4/02 (H5N1)) polymerase (PB2) gene, partial cds. |
| gi\|47834801\|AY576387\| | Influenza A virus (A/Ck/HK/61.9/02 (H5N1)) polymerase (PB2) gene, partial cds. |
| gi\|47834803\|AY576388\| | Influenza A virus (A/Ck/HK/YU777/02 (H5N1)) polymerase (PB2) gene, partial cds. |
| gi\|47834805\|AY576389\| | Influenza A virus (A/Ck/HK/96.1/02 (H5N1)) polymerase (PB2) gene, partial cds. |
| gi\|47834807\|AY576390\| | Influenza A virus (A/Ck/HK/409.1/02 (H5N1)) polymerase (PB2) gene, partial cds. |
| gi\|47834809\|AY576391\| | Influenza A virus (A/Ph/HK/sv674.15/02 (H5N1)) polymerase (PB2) gene, partial cds. |
| gi\|47156226\|AY585504\| | Influenza A virus (A/duck/Fujian/01/2002(H5N1)) polymerase basic protein 2 (PB2) mRNA, complete cds. |
| gi\|47156228\|AY585505\| | Influenza A virus (A/duck/Fujian/13/2002(H5N1)) polymerase basic protein 2 (PB2) mRNA, complete cds. |
| gi\|50296597\|AY651744\| | Influenza A virus (A/grey heron/HK/861.1/2002(H5N1)) polymerase basic subunit 2 (PB2) gene, partial cds. |
| gi\|50296599\|AY651745\| | Influenza A virus (A/feral pigeon/HK/862.7/2002(H5N1)) polymerase basic subunit 2 (PB2) gene, partial cds. |
| gi\|50296601\|AY651746\| | Influenza A virus (A/tree sparrow/HK/864/2002(H5N1)) polymerase basic subunit 2 (PB2) gene, partial cds. |
| gi\|50296603\|AY651747\| | Influenza A virus (A/teal/China/2978.1/2002(H5N1)) polymerase basic subunit 2 (PB2) gene, partial cds. |
| gi\|56548879\|AY676021\| | Influenza A virus (A/duck/Hong Kong/821/02(H5N1)) polymerase basic 2 (PB2) gene, complete cds. |

TABLE 6-continued

| | |
|---|---|
| gi\|50296569\|AY651730\| | Influenza A virus (A/Gf/HK/38/2002(H5N1)) polymerase basic subunit 2 (PB2) gene, partial cds. |
| gi\|50296571\|AY651731\| | Influenza A virus (A/Ck/HK/31.2/2002(H5N1)) polymerase basic subunit 2 (PB2) gene, partial cds. |
| gi\|50296573\|AY651732\| | Influenza A virus (A/Ck/HK/37.4/2002(H5N1)) polymerase basic subunit 2 (PB2) gene, partial cds. |
| gi\|50296575\|AY651733\| | Influenza A virus (A/SCk/HK/YU100/2002(H5N1)) polymerase basic subunit 2 (PB2) gene, partial cds. |
| gi\|50296577\|AY651734\| | Influenza A virus (A/Ck/HK/YU22/2002(H5N1)) polymerase basic subunit 2 (PB2) gene, partial cds. |
| gi\|50296579\|AY651735\| | Influenza A virus (A/Ck/HK/3176.3/2002(H5N1)) polymerase basic subunit 2 (PB2) gene, partial cds. |
| gi\|50296581\|AY651736\| | Influenza A virus (A/Ck/HK/3169.1/2002(H5N1)) polymerase basic subunit 2 (PB2) gene, partial cds. |
| gi\|50296583\|AY651737\| | Influenza A virus (A/Ck/HK/FY157/2003(H5N1)) polymerase basic subunit 2 (PB2) gene, partial cds. |
| gi\|50296585\|AY651738\| | Influenza A virus (A/Ck/HK/YU324/2003(H5N1)) polymerase basic subunit 2 (PB2) gene, partial cds. |
| gi\|50296587\|AY651739\| | Influenza A virus (A/Ck/HK/2133.1/2003(H5N1)) polymerase basic subunit 2 (PB2) gene, partial cds. |
| gi\|50296589\|AY651740\| | Influenza A virus (A/Ck/HK/NT93/2003(H5N1)) polymerase basic subunit 2 (PB2) gene, partial cds. |
| gi\|50296591\|AY651741\| | Influenza A virus (A/Ck/HK/SSP141/2003(H5N1)) polymerase basic subunit 2 (PB2) gene, partial cds. |
| gi\|50296593\|AY651742\| | Influenza A virus (A/Ck/HK/WF157/2003(H5N1)) polymerase basic subunit 2 (PB2) gene, partial cds. |
| gi\|50296595\|AY651743\| | Influenza A virus (A/black headed gull/HK/12.1/2003(H5N1)) polymerase basic subunit 2 (PB2) gene, partial cds. |
| gi\|50296607\|AY651749\| | Influenza A virus (A/Dk/HN/5806/2003(H5N1)) polymerase basic subunit 2 (PB2) gene, partial cds. |
| gi\|50296609\|AY651750\| | Influenza A virus (A/Dk/ST/4003/2003(H5N1)) polymerase basic subunit 2 (PB2) gene, partial cds. |
| gi\|50296611\|AY651751\| | Influenza A virus (A/Ck/ST/4231/2003(H5N1)) polymerase basic subunit 2 (PB2) gene, partial cds. |
| gi\|50296613\|AY651752\| | Influenza A virus (A/Dk/YN/6255/2003(H5N1)) polymerase basic subunit 2 (PB2) gene, partial cds. |
| gi\|50296615\|AY651753\| | Influenza A virus (A/Dk/YN/6445/2003(H5N1)) polymerase basic subunit 2 (PB2) gene, partial cds. |
| gi\|50296529\|AY651710\| | Influenza A virus (A/Ck/Indonesia/2A/2003(H5N1)) polymerase basic subunit 2 (PB2) gene, partial cds. |
| gi\|56548881\|AY676022\| | Influenza A virus (A/egret/Hong Kong/757.2/03(H5N1)) polymerase basic 2 (PB2) gene, complete cds. |
| gi\|56548883\|AY676023\| | Influenza A virus (A/chicken/Korea/ES/03(H5N1)) polymerase basic 2 (PB2) gene, complete cds. |
| gi\|56548885\|AY676024\| | Influenza A virus (A/duck/Korea/ESD1/03(H5N1)) polymerase basic 2 (PB2) gene, complete cds. |
| gi\|50296519\|AY651705\| | Influenza A virus (A/Ck/Indonesia/PA/2003(H5N1)) polymerase basic subunit 2 (PB2) gene, complete cds. |
| gi\|50296523\|AY651707\| | Influenza A virus (A/Ck/Indonesia/BL/2003(H5N1)) polymerase basic subunit 2 (PB2) gene, complete cds. |
| gi\|41207501\|AY518367\| | Influenza A virus (A/duck/China/E319-2/03(H5N1)) polymerase subunit PB2 (PB2) gene, complete cds. |
| gi\|45359369\|AY550147\| | Influenza A virus (A/chicken/Nakorn-Patom Thailand/CU-K2/04(H5N1)) polymerase basic protein 2 (PB2) gene, partial cds. |
| gi\|50296525\|AY651708\| | Influenza A virus (A/Ck/Indonesia/5/2004(H5N1)) polymerase basic subunit 2 (PB2) gene, partial cds. |
| gi\|50296527\|AY651709\| | Influenza A virus (A/Ck/Indonesia/4/2004(H5N1)) polymerase basic subunit 2 (PB2) gene, partial cds. |
| gi\|50296521\|AY651706\| | Influenza A virus (A/Dk/Indonesia/MS/2004(H5N1)) polymerase basic subunit 2 (PB2) gene, complete cds. |
| gi\|51094103\|AY590581\| | Influenza A virus (A/chicken/Nakorn-Patom/Thailand/CU-K2/2004(H5N1)) polymerase basic protein 2 (PBP2) gene, partial cds. |
| gi\|47716766\|AY609309\| | Influenza A virus (A/chicken/Guangdong/174/04(H5N1)) segment 1, complete sequence. |
| gi\|58531082\|AB166859\| | Influenza A virus (A/chicken/Yamaguchi/7/2004(H5N1)) PB2 gene for polymerase basic protein 2, complete cds. |
| gi\|58531114\|AB188813\| | Influenza A virus (A/chicken/Oita/8/2004(H5N1)) PB2 gene for polymerase basic protein 2, complete cds. |
| gi\|50956621\|AY684703\| | Influenza A virus (A/chicken/Hubei/327/2004(H5N1)) polymerase basic protein 2 (PB2) gene, complete cds. |
| gi\|57915957\|AY737286\| | Influenza A virus (A/chicken/Guangdong/191/04(H5N1)) segment 1, complete sequence. |
| gi\|57916006\|AY737293\| | Influenza A virus (A/chicken/Guangdong/178/04(H5N1)) segment 1, complete sequence. |
| gi\|57916060\|AY737301\| | Influenza A virus (A/duck/Guangdong/173/04(H5N1)) segment 1, complete sequence. |

TABLE 6-continued

| | |
|---|---|
| gi\|55233237\|AY770084\| | Influenza A virus (A/chicken/Hubei/489/2004(H5N1)) polymerase basic protein 2 (PB2) gene, complete cds. |
| gi\|54873461\|AY770993\| | Influenza A virus (A/chicken/Ayutthaya/Thailand/CU-23/04(H5N1)) polymerase basic protein 2 gene, partial cds. |
| gi\|58618421\|AY818127\| | Influenza A virus (A/chicken/Vietnam/C58/04(H5N1)) polymerase protein PB2 gene, complete cds. |
| gi\|58618423\|AY818128\| | Influenza A virus (A/quail/Vietnam/36/04(H5N1)) polymerase protein PB2 gene, complete cds. |
| gi\|58374183\|AY856861\| | Influenza A virus (A/duck/Shandong/093/2004(H5N1)) segment 1, complete sequence. |
| gi\|58531132\|AB188821\| | Influenza A virus (A/chicken/Kyoto/3/2004(H5N1)) PB2 gene for polymerase basic protein 2, complete cds. |
| gi\|58531150\|AB189050\| | Influenza A virus (A/crow/Kyoto/53/2004(H5N1)) PB2 gene for polymerase basic protein 2, complete cds,. |
| gi\|58531168\|AB189058\| | Influenza A virus (A/crow/Osaka/102/2004(H5N1)) PB2 gene for polymerase basic protein 2, complete cds,. |
| gi\|50296605\|AY651748\| | Influenza A virus (A/peregrine falcon/HK/D0028/2004(H5N1)) polymerase basic subunit 2 (PB2) gene, complete cds. |
| gi\|50296531\|AY651711\| | Influenza A virus (A/Ck/Thailand/1/2004(H5N1)) polymerase basic subunit 2 (PB2) gene, partial cds. |
| gi\|50296533\|AY651712\| | Influenza A virus (A/Ck/Thailand/73/2004(H5N1)) polymerase basic subunit 2 (PB2) gene, partial cds. |
| gi\|50296535\|AY651713\| | Influenza A virus (A/Ck/Thailand/9.1/2004(H5N1)) polymerase basic subunit 2 (PB2) gene, complete cds. |
| gi\|50296537\|AY651714\| | Influenza A virus (A/Qa/Thailand/57/2004(H5N1)) polymerase basic subunit 2 (PB2) gene, complete cds. |
| gi\|50296539\|AY651715\| | Influenza A virus (A/bird/Thailand/3.1/2004(H5N1)) polymerase basic subunit 2 (PB2) gene, complete cds. |
| gi\|50296541\|AY651716\| | Influenza A virus (A/Dk/Thailand/71.1/2004(H5N1)) polymerase basic subunit 2 (PB2) gene, complete cds. |
| gi\|50296543\|AY651717\| | Influenza A virus (A/Gs/Thailand/79/2004(H5N1)) polymerase basic subunit 2 (PB2) gene, partial cds. |
| gi\|50296553\|AY651722\| | Influenza A virus (A/Ck/Viet Nam/33/2004(H5N1)) polymerase basic subunit 2 (PB2) gene, complete cds. |
| gi\|50296555\|AY651723\| | Influenza A virus (A/Ck/Viet Nam/35/2004(H5N1)) polymerase basic subunit 2 (PB2) gene, complete cds. |
| gi\|50296557\|AY651724\| | Influenza A virus (A/Ck/Viet Nam/36/2004(H5N1)) polymerase basic subunit 2 (PB2) gene, complete cds. |
| gi\|50296559\|AY651725\| | Influenza A virus (A/Ck/Viet Nam/37/2004(H5N1)) polymerase basic subunit 2 (PB2) gene, complete cds. |
| gi\|50296561\|AY651726\| | Influenza A virus (A/Ck/Viet Nam/38/2004(H5N1)) polymerase basic subunit 2 (PB2) gene, complete cds. |
| gi\|50296563\|AY651727\| | Influenza A virus (A/Ck/Viet Nam/39/2004(H5N1)) polymerase basic subunit 2 (PB2) gene, complete cds. |
| gi\|50296565\|AY651728\| | Influenza A virus (A/Ck/Viet Nam/C57/2004(H5N1)) polymerase basic subunit 2 (PB2) gene, complete cds. |
| gi\|50296567\|AY651729\| | Influenza A virus (A/Dk/Viet Nam/11/2004(H5N1)) polymerase basic subunit 2 (PB2) gene, complete cds. |
| gi\|50296617\|AY651754\| | Influenza A virus (A/Ck/YN/374/2004(H5N1)) polymerase basic subunit 2 (PB2) gene, partial cds. |
| gi\|50296619\|AY651755\| | Influenza A virus (A/Ck/YN/115/2004(H5N1)) polymerase basic subunit 2 (PB2) gene, partial cds. |
| gi\|50296621\|AY651756\| | Influenza A virus (A/Ph/ST/44/2004(H5N1)) polymerase basic subunit 2 (PB2) gene, partial cds. |
| gi\|50296623\|AY651757\| | Influenza A virus (A/Dk/HN/303/2004(H5N1)) polymerase basic subunit 2 (PB2) gene, partial cds. |
| gi\|50296625\|AY651758\| | Influenza A virus (A/Dk/HN/101/2004(H5N1)) polymerase basic subunit 2 (PB2) gene, partial cds. |
| gi\|50365712\|AY653193\| | Influenza A virus (A/chicken/Jilin/9/2004(H5N1)) segment 1, complete sequence. |
| gi\|47680940\|AY586445\| | Influenza A Virus (A/mallard/Italy/43/01(H7N3)) PB2 gene, partial cds. |
| gi\|47680930\|AY586440\| | Influenza A virus (A/mallard/Italy/33/01(H7N3)) PB2 gene, partial cds. |
| gi\|47680932\|AY586441\| | Influenza A virus (A/turkey/Italy/220158/2002(H7N3)) PB2 gene, partial cds. |
| gi\|45124743\|AJ627485\| | Influenza A virus (A/turkey/Italy/214845/2002(H7N3)) PB2 gene for RNA polymerase, genomic RNA. |
| gi\|45124767\|AJ627496\| | Influenza A virus (A/turkey/Italy/220158/2002(H7N3)) PB2 gene for RNA polymerase, genomic RNA. |
| gi\|34597782\|AY303665\| | Influenza A virus (A/chicken/Chile/176822/02(H7N3)) polymerase basic protein 2 gene, partial cds. |
| gi\|34597784\|AY303666\| | Influenza A virus (A/chicken/Chile/4957/02(H7N3)) polymerase basic protein 2 gene, partial cds. |
| gi\|47680928\|AY586439\| | Influenza A Virus (A/turkey/Italy/214845/02(H7N3)) PB2 gene, partial cds. |
| gi\|47834374\|AY616766\| | Influenza A virus (A/chicken/British Columbia/04(H7N3)) PB2 polymerase subunit (PB2) gene, complete cds. |

TABLE 6-continued

| | |
|---|---|
| gi\|50542651\|AY646085\| | Influenza A virus (A/chicken/British Columbia/GSC_human_B/04(H7N3)) polymerase basic protein 2 (PB2) gene, complete cds. |
| gi\|50083053\|AY648294\| | Influenza A virus (A/GSC_chicken_B/British Columbia/04(H7N3)) PB2 polymerase subunit (PB2) gene, complete cds. |
| gi\|50059194\|AY650276\| | Influenza A virus (A/GSC_chicken/British Columbia/04(H7N3)) PB2 polymerase subunit (PB2) gene, complete cds. |
| gi\|60700\|X58691\| | Influenza A virus (A/FPV/Dobson/27 (H7N7)) gene for cap-binding protein PB2, genomic RNA |
| gi\|325001\|M38291\| | Influenza virus A/FPV/Weybridge polymerase basic 2 protein (PB2) (seg 3) gene, complete cds. |
| gi\|9988661\|AF268120\| | Influenza A virus (A/RedKnot/Delaware/259/94(H7N7)) polymerase protein PB2 gene, partial cds. |
| gi\|40732893\|AJ620347\| | Influenza A virus ((A/Chicken/Germany/R28/03(H7N7)) A/Chicken/Germany/R28/03(H7N7)) PB2 gene for RNA polymerase, genomic RNA. |
| gi\|37813157\|AY342410\| | Influenza A virus (A/Netherlands/124/03(H7N7)) polymerase protein 2 gene, partial cds. |
| gi\|37813159\|AY342411\| | Influenza A virus (A/Netherlands/126/03(H7N7)) polymerase protein 2 gene, partial cds. |
| gi\|37813161\|AY342412\| | Influenza A virus (A/Netherlands/127/03(H7N7)) polymerase protein 2 gene, partial cds. |
| gi\|37813163\|AY342413\| | Influenza A virus (A/Netherlands/219/03(H7N7)) polymerase protein 2 gene, partial cds. |
| gi\|37813165\|AY342414\| | Influenza A virus (A/chicken/Netherlands/1/03(H7N7)) polymerase protein 2 gene, partial cds. |
| gi\|5732354\|AF156443\| | Influenza A virus (A/Turkey/California/189/66(H9N2)) segment 1 PB2 polymerase subunit (PB2) gene, partial cds. |
| gi\|31339587\|AF523469\| | Influenza A virus (A/Duck/Hong Kong/86/76(H9N2)) polymerase (PB2) gene, partial cds. |
| gi\|31339583\|AF523467\| | Influenza A virus (A/Duck/Hong Kong/366/78(H9N2)) polymerase (PB2) gene, partial cds. |
| gi\|31339605\|AF523478\| | Influenza A virus (A/Duck/Hong Kong/289/78(H9N2)) polymerase (PB2) gene, partial cds. |
| gi\|31339585\|AF523468\| | Influenza A virus (A/Duck/Hong Kong/552/79(H9N2)) polymerase (PB2) gene, partial cds. |
| gi\|31339589\|AF523470\| | Influenza A virus (A/Duck/Hong Kong/610/79(H9N2)) polymerase (PB2) gene, partial cds. |
| gi\|49356935\|AY633283\| | Influenza A virus (A/mallard/Alberta/321/88(H9N2)) polymerase basic protein 2 (PB2) gene, partial cds. |
| gi\|49356939\|AY633299\| | Influenza A virus (A/mallard/Alberta/11/91(H9N2)) polymerase basic protein 2 (PB2) gene, partial cds. |
| gi\|49356907\|AY633171\| | Influenza A virus (A/mallard/Alberta/17/91(H9N2)) polymerase basic protein 2 (PB2) gene, partial cds. |
| gi\|5732342\|AF156437\| | Influenza A virus (A/Quail/Hong Kong/AF157/92(H9N2)) segment 1 PB2 polymerase subunit (PB2) gene, partial cds. |
| gi\|5732352\|AF156442\| | Influenza A virus (A/Quail/Arkansas/29209-1/93(H9N2)) segment 1 PB2 polymerase subunit (PB2) gene, partial cds. |
| gi\|5732340\|AF156436\| | Influenza A virus (A/Chicken/Hong Kong/739/94(H9N2)) segment 1 PB2 polymerase subunit (PB2) gene, partial cds. |
| gi\|5732344\|AF156438\| | Influenza A virus (A/Chicken/Beijing/1/94(H9N2)) segment 1 PB2 polymerase subunit (PB2) gene, partial cds. |
| gi\|22759060\|AF536679\| | Influenza A virus (A/Chicken/Beijing/1/95(H9N2)) PB2 gene, partial cds. |
| gi\|33318110\|AF508640\| | Influenza A virus (A/Ostrich/South Africa/9508103/95(H9N2)) segment 1 polymerase PB2 (PB2) gene, complete cds. |
| gi\|33318118\|AF508644\| | Influenza A virus (A/Duck/Germany/113/95(H9N2)) segment 1 polymerase PB2 (PB2) gene, partial cds. |
| gi\|33318144\|AF508657\| | Influenza A virus (A/Chicken/Shandong/6/96(H9N2)) segment 1 polymerase PB2 (PB2) gene, partial cds. |
| gi\|33318152\|AF508661\| | Influenza A virus (A/Quail/Shanghai/8/96(H9N2)) segment 1 polymerase PB2 (PB2) gene, partial cds. |
| gi\|5732346\|AF156439\| | Influenza A virus (A/Chicken/Korea/38349-p96323/96(H9N2)) segment 1 PB2 polymerase subunit (PB2) gene, partial cds. |
| gi\|5732348\|AF156440\| | Influenza A virus (A/Chicken/Korea/25232-96006/96(H9N2)) segment 1 PB2 polymerase subunit (PB2) gene, partial cds. |
| gi\|5732350\|AF156441\| | Influenza A virus (A/Shorebird/Delaware/9/96(H9N2)) segment 1 PB2 polymerase subunit (PB2) gene, partial cds. |
| gi\|22759068\|AF536683\| | Influenza A virus (A/Chicken/Hebei/1/96(H9N2)) PB2 gene, partial cds. |
| gi\|5732328\|AF156430\| | Influenza A virus (A/Chicken/Hong Kong/G9/97(H9N2)) segment 1 PB2 polymerase subunit (PB2) gene, complete cds. |
| gi\|5732330\|AF156431\| | Influenza A virus (A/Chicken/Hong Kong/G23/97(H9N2)) segment 1 PB2 polymerase subunit (PB2) gene, partial cds. |
| gi\|5732332\|AF156432\| | Influenza A virus (A/Pigeon/Hong Kong/Y233/97(H9N2)) segment 1 PB2 polymerase subunit (PB2) gene, partial cds. |
| gi\|5732334\|AF156433\| | Influenza A virus (A/Duck/Hong Kong/Y280/97(H9N2)) segment 1 PB2 polymerase subunit (PB2) gene, partial cds. |
| gi\|5732336\|AF156434\| | Influenza A virus (A/Duck/Hong Kong/Y439/97(H9N2)) segment 1 PB2 polymerase subunit (PB2) gene, partial cds. |

TABLE 6-continued

| | |
|---|---|
| gi\|5732338\|AF156435\| | Influenza A virus (A/Quail/Hong Kong/G1/97 (H9N2)) segment 1 PB2 polymerase subunit (PB2) gene, partial cds. |
| gi\|33318148\|AF508659\| | Influenza A virus (A/Chicken/Shenzhen/9/97(H9N2)) segment 1 polymerase PB2 (PB2) gene, partial cds. |
| gi\|33318150\|AF508660\| | Influenza A virus (A/Duck/Nanjing/1/97(H9N2)) segment 1 polymerase PB2 (PB2) gene, partial cds. |
| gi\|33318124\|AF508647\| | Influenza A virus (A/Pheasant/Ireland/PV18/97(H9N2)) segment 1 polymerase PB2 (PB2) gene, partial cds. |
| gi\|13383266\|AB049153\| | Influenza A virus (A/parakeet/Chiba/1/97(H9N2)) PB2 gene for polymerase basic protein 2, complete cds. |
| gi\|33318132\|AF508651\| | Influenza A virus (A/Chicken/Guangdong/11/97(H9N2)) segment 1 polymerase PB2 (PB2) gene, partial cds. |
| gi\|33318136\|AF508653\| | Influenza A virus (A/Chicken/Heilongjiang/10/97(H9N2)) segment 1 polymerase PB2 (PB2) gene, partial cds. |
| gi\|22759062\|AF536680\| | Influenza A virus (A/Chicken/Beijing/2/97(H9N2)) PB2 gene, partial cds. |
| gi\|33318142\|AF508656\| | Influenza A virus (A/Chicken/Sichuan/5/97(H9N2)) segment 1 polymerase PB2 (PB2) gene, partial cds. |
| gi\|22759066\|AF536682\| | Influenza A virus (A/Chicken/Guangdong/97(H9N2)) PB2 gene, partial cds. |
| gi\|22759078\|AF536688\| | Influenza A virus (A/Chicken/Shandong/98(H9N2)) PB2 gene, partial cds. |
| gi\|33318116\|AF508643\| | Influenza A virus (A/Chicken/Germany/R45/98(H9N2)) segment 1 polymerase PB2 (PB2) gene, partial cds. |
| gi\|33318134\|AF508652\| | Influenza A virus (A/Chicken/Hebei/4/98(H9N2)) segment 1 polymerase PB2 (PB2) gene, partial cds. |
| gi\|33318128\|AF508649\| | Influenza A virus (A/Chicken/Beijing/8/98(H9N2)) segment 1 polymerase PB2 (PB2) gene, complete cds. |
| gi\|13383268\|AB049154\| | Influenza A virus (A/parakeet/Narita/92A/98(H9N2)) PB2 gene for polymerase basic protein 2, complete cds. |
| gi\|22759070\|AF536684\| | Influenza A virus (A/Chicken/Hebei/2/98(H9N2)) PB2 gene, partial cds. |
| gi\|22759072\|AF536685\| | Influenza A virus (A/Chicken/Hebei/3/98(H9N2)) PB2 gene, partial cds. |
| gi\|22759074\|AF536686\| | Influenza A virus (A/Chicken/Henan/98(H9N2)) PB2 gene, partial cds. |
| gi\|30025722\|AY253750\| | Influenza A virus (A/Chicken/Shanghai/F/98(H9N2)) RNA polymerase (PB2) gene, complete cds. |
| gi\|12060631\|AF222622\| | Influenza A virus (A/Quail/Hong Kong/A17/99(H9N2)) segment 1 polymerase 2 (PB2) gene, partial cds. |
| gi\|12060633\|AF222623\| | Influenza A virus (A/Pigeon/Hong Kong/FY6/99(H9N2)) segment 1 polymerase 2 (PB2) gene, partial cds. |
| gi\|12060635\|AF222624\| | Influenza A virus (A/Chicken/Hong Kong/NT16/99(H9N2)) segment 1 polymerase 2 (PB2) gene, partial cds. |
| gi\|12060637\|AF222625\| | Influenza A virus (A/Quail/Hong Kong/SSP10/99(H9N2)) segment 1 polymerase 2 (PB2) gene, partial cds. |
| gi\|12060639\|AF222626\| | Influenza A virus (A/Pheasant/Hong Kong/SSP11/99(H9N2)) segment 1 polymerase 2 (PB2) gene, partial cds. |
| gi\|12060641\|AF222627\| | Influenza A virus (A/Chicken/Hong Kong/FY20/99(H9N2)) segment 1 polymerase 2 (PB2) gene, partial cds. |
| gi\|12060643\|AF222628\| | Influenza A virus (A/Chicken/Hong Kong/KC12/99(H9N2)) segment 1 polymerase 2 (PB2) gene, partial cds. |
| gi\|12060645\|AF222629\| | Influenza A virus (A/Quail/Hong Kong/NT28/99(H9N2)) segment 1 polymerase 2 (PB2) gene, partial cds. |
| gi\|12060647\|AF222630\| | Influenza A virus (A/Chicken/Hong Kong/SF2/99(H9N2)) segment 1 polymerase 2 (PB2) gene, partial cds. |
| gi\|12060649\|AF222631\| | Influenza A virus (A/Silky Chicken/Hong Kong/SF44/99(H9N2)) segment 1 polymerase 2 (PB2) gene, partial cds. |
| gi\|22759076\|AF536687\| | Influenza A virus (A/Chicken/Liaoning/99(H9N2)) PB2 gene, partial cds. |
| gi\|33318112\|AF508641\| | Influenza A virus (A/Chicken/Pakistan/4/99(H9N2)) segment 1 polymerase PB2 (PB2) gene, complete cds. |
| gi\|33318114\|AF508642\| | Influenza A virus (A/Chicken/Pakistan/5/99(H9N2)) segment 1 polymerase PB2 (PB2) gene, complete cds. |
| gi\|33318126\|AF508648\| | Influenza A virus (A/Chicken/Korea/99029/99(H9N2)) segment 1 polymerase PB2 (PB2) gene, partial cds. |
| gi\|33318120\|AF508645\| | Influenza A virus (A/Chicken/Iran/11T/99(H9N2)) segment 1 polymerase PB2 (PB2) gene, complete cds. |
| gi\|33318122\|AF508646\| | Influenza A virus (A/Chicken/Saudi Arabia/532/99(H9N2)) segment 1 polymerase PB2 (PB2) gene, partial cds. |
| gi\|33318140\|AF508655\| | Influenza A virus (A/Chicken/Ningxia/5/99(H9N2)) segment 1 polymerase PB2 (PB2) gene, partial cds. |
| gi\|33318146\|AF508658\| | Influenza A virus (A/Chicken/Shijiazhuang/2/99(H9N2)) segment 1 polymerase PB2 (PB2) gene, partial cds. |
| gi\|12038893\|AJ291395\| | Influenza A virus (A/Chicken/Pakistan/2/99 (H9N2)) PB2 gene for polymerase PB2, genomic RNA. |
| gi\|22759064\|AF536681\| | Influenza A virus (A/Chicken/Beijing/3/99(H9N2)) PB2 gene, partial cds. |

TABLE 6-continued

| | |
|---|---|
| gi\|31339607\|AF523479\| | Influenza A virus (A/Duck/Shantou/1881/00(H9N2)) polymerase (PB2) gene, partial cds. |
| gi\|31339601\|AF523476\| | Influenza A virus (A/Duck/Shantou/830/00(H9N2)) polymerase (PB2) gene, partial cds. |
| gi\|31339603\|AF523477\| | Influenza A virus (A/Duck/Shantou/1796/00(H9N2)) polymerase (PB2) gene, partial cds. |
| gi\|18496117\|AJ427861\| | Influenza A virus (A/quail/Hong Kong/FY298/00 (H9N2)) partial pb2 gene for PB2 polymerase protein, genomic RNA |
| gi\|27466041\|AY180715\| | Influenza A virus strain A/Wild Duck/Nanchang/2-0480/2000 (H9N2) polymerase subunit PB2 (PB2) gene, partial cds. |
| gi\|27466043\|AY180716\| | Influenza A virus strain A/Pigeon/Nanchang/2-0461/2000 (H9N2) polymerase subunit PB2 (PB2) gene, partial cds. |
| gi\|27466045\|AY180717\| | Influenza A virus strain A/Duck/Nanchang/1-0070/2000 (H9N2) polymerase subunit PB2 (PB2) gene, partial cds. |
| gi\|27466055\|AY180722\| | Influenza A virus strain A/Duck/Nanchang/10-389/2000 (H9N2) polymerase subunit PB2 (PB2) gene, partial cds. |
| gi\|27466057\|AY180723\| | Influenza A virus strain A/Pigeon/Nanchang/7-058/2000 (H9N2) polymerase subunit PB2 (PB2) gene, partial cds. |
| gi\|27466067\|AY180728\| | Influenza A virus strain A/Quail/Nanchang/2-0460/2000 (H9N2) polymerase subunit PB2 (PB2) gene, partial cds. |
| gi\|27466085\|AY180737\| | Influenza A virus strain A/Pigeon/Nanchang/11-145/2000 (H9N2) polymerase subunit PB2 (PB2) gene, partial cds. |
| gi\|27466087\|AY180738\| | Influenza A virus strain A/Duck/Nanchang/11-197/2000 (H9N2) polymerase subunit PB2 (PB2) gene, partial cds. |
| gi\|27466091\|AY180740\| | Influenza A virus strain A/Duck/Nanchang/11-290/2000 (H9N2) polymerase subunit PB2 (PB2) gene, partial cds. |
| gi\|27466093\|AY180741\| | Influenza A virus strain A/Duck/Nanchang/11-392/2000 (H9N2) polymerase subunit PB2 (PB2) gene, partial cds. |
| gi\|31339575\|AF523463\| | Influenza A virus (A/Duck/Shantou/2134/00(H9N2)) polymerase (PB2) gene, partial cds. |
| gi\|31339579\|AF523465\| | Influenza A virus (A/Duck/Shantou/1043/00(H9N2)) polymerase (PB2) gene, partial cds. |
| gi\|31339581\|AF523466\| | Influenza A virus (A/Duck/Shantou/1042/00(H9N2)) polymerase (PB2) gene, partial cds. |
| gi\|31339593\|AF523472\| | Influenza A virus (A/Duck/Shantou/2102/00(H9N2)) polymerase (PB2) gene, partial cds. |
| gi\|31339595\|AF523473\| | Influenza A virus (A/Duck/Shantou/2144/00(H9N2)) polymerase (PB2) gene, partial cds. |
| gi\|31339597\|AF523474\| | Influenza A virus (A/Duck/Shantou/2143/00(H9N2)) polymerase (PB2) gene, partial cds. |
| gi\|33318138\|AF508654\| | Influenza A virus (A/Chicken/Henan/62/00(H9N2)) segment 1 polymerase PB2 (PB2) gene, partial cds. |
| gi\|33318130\|AF508650\| | Influenza A virus (A/Chicken/Guangdong/10/00(H9N2)) segment 1 polymerase PB2 (PB2) gene, partial cds. |
| gi\|27466121\|AY180755\| | Influenza A virus strain A/Duck/Nanchang/7-092/2000 (H9N2) polymerase subunit PB2 (PB2) gene, partial cds. |
| gi\|27466141\|AY180765\| | Influenza A virus strain A/Chicken/Nanchang/4-010/2000 (H9N2) polymerase subunit PB2 (PB2) gene, partial cds. |
| gi\|27466157\|AY180773\| | Influenza A virus strain A/Quail/Nanchang/4-040/2000 (H9N2) polymerase subunit PB2 (PB2) gene, partial cds. |
| gi\|27466159\|AY180774\| | Influenza A virus strain A/Chicken/Nanchang/1-0016/2000 (H9N2) polymerase subunit PB2 (PB2) gene, partial cds. |
| gi\|55469788\|AY768575\| | Influenza A virus (A/chicken/Korea/SNU0028/00(H9N2)) polymerase basic subunit 2 (PB2) gene, partial cds. |
| gi\|55469790\|AY768576\| | Influenza A virus (A/chicken/Korea/SNU0037/00(H9N2)) polymerase basic subunit 2 (PB2) gene, partial cds. |
| gi\|55469792\|AY768577\| | Influenza A virus (A/chicken/Korea/SNU0073/00(H9N2)) polymerase basic subunit 2 (PB2) gene, partial cds. |
| gi\|55469794\|AY768578\| | Influenza A virus (A/chicken/Korea/SNU0091/00(H9N2)) polymerase basic subunit 2 (PB2) gene, partial cds. |
| gi\|55469796\|AY768579\| | Influenza A virus (A/chicken/Korea/SNU0140/00(H9N2)) polymerase basic subunit 2 (PB2) gene, partial cds. |
| gi\|55469798\|AY768580\| | Influenza A virus (A/chicken/Korea/SNU0146/00(H9N2)) polymerase basic subunit 2 (PB2) gene, partial cds. |
| gi\|55469800\|AY768581\| | Influenza A virus (A/chicken/Korea/SNU1035C/00(H9N2)) polymerase basic subunit 2 (PB2) gene, partial cds. |
| gi\|27466143\|AY180766\| | Influenza A virus strain A/Chicken/Nanchang/4-301/2001 (H9N2) polymerase subunit PB2 (PB2) gene, partial cds. |
| gi\|31339599\|AF523475\| | Influenza A virus (A/Duck/Shantou/2088/01(H9N2)) polymerase (PB2) gene, partial cds. |
| gi\|31339591\|AF523471\| | Influenza A virus (A/Duck/Shantou/1605/01(H9N2)) polymerase (PB2) gene, partial cds. |
| gi\|31339577\|AF523464\| | Influenza A virus (A/Wild Duck/Shantou/4808/01(H9N2)) polymerase (PB2) gene, partial cds. |
| gi\|27466097\|AY180743\| | Influenza A virus strain A/Chicken/Nanchang/4-361/2001 (H9N2) polymerase subunit PB2 (PB2) gene, partial cds. |
| gi\|54398631\|AY664792\| | Influenza A virus (A/chicken/HongKong/CSW153/03(H9N2)) polymerase basic protein 2 (PB2) gene, partial cds. |

TABLE 6-continued

| | |
|---|---|
| gi\|54398633\|AY664793\| | Influenza A virus (A/chicken/HongKong/AP45/03(H9N2)) polymerase basic protein 2 (PB2) gene, partial cds. |
| gi\|54398635\|AY664794\| | Influenza A virus (A/chicken/HongKong/BD90/03(H9N2)) polymerase basic protein 2 (PB2) gene, partial cds. |
| gi\|54398637\|AY664795\| | Influenza A virus (A/chicken/HongKong/CSW291/03(H9N2)) nonfunctional polymerase basic protein 2 (PB2) gene, partial sequence. |
| gi\|54398638\|AY664796\| | Influenza A virus (A/chicken/HongKong/CSW304/03(H9N2)) nonfunctional polymerase basic protein 2 (PB2) gene, partial sequence. |
| gi\|54398639\|AY664797\| | Influenza A virus (A/chicken/HongKong/FY23/03(H9N2)) nonfunctional polymerase basic protein 2 (PB2) gene, partial sequence. |
| gi\|54398640\|AY664798\| | Influenza A virus (A/guineafowl/HongKong/NT101/03(H9N2)) polymerase basic protein 2 (PB2) gene, partial cds. |
| gi\|54398642\|AY664799\| | Influenza A virus (A/chicken/HongKong/NT142/03(H9N2)) polymerase basic protein 2 (PB2) gene, partial cds. |
| gi\|54398644\|AY664800\| | Influenza A virus (A/chicken/HongKong/SF1/03(H9N2)) nonfunctional polymerase basic protein 2 (PB2) gene, partial sequence. |
| gi\|54398645\|AY664801\| | Influenza A virus (A/chicken/HongKong/SSP101/03(H9N2)) nonfunctional polymerase basic protein 2 (PB2) gene, partial sequence. |
| gi\|54398646\|AY664802\| | Influenza A virus (A/chicken/HongKong/TP38/03(H9N2)) polymerase basic protein 2 (PB2) gene, partial cds. |
| gi\|54398648\|AY664803\| | Influenza A virus (A/chicken/HongKong/WF126/03(H9N2)) nonfunctional polymerase basic protein 2 (PB2) gene, partial sequence. |
| gi\|54398649\|AY664804\| | Influenza A virus (A/pigeon/HongKong/WF53/03(H9N2)) nonfunctional polymerase basic protein 2 (PB2) gene, partial sequence. |
| gi\|54398650\|AY664805\| | Influenza A virus (A/pheasant/HongKong/WF54/03(H9N2)) nonfunctional polymerase basic protein 2 (PB2) gene, partial sequence. |
| gi\|54398651\|AY664806\| | Influenza A virus (A/guineafowl/HongKong/NT184/03(H9N2)) polymerase basic protein 2 (PB2) gene, partial cds. |
| gi\|54398653\|AY664807\| | Influenza A virus (A/chicken/HongKong/WF120/03(H9N2)) nonfunctional polymerase basic protein 2 (PB2) gene, partial sequence. |
| gi\|54398654\|AY664808\| | Influenza A virus (A/chicken/HongKong/NT366/03(H9N2)) polymerase basic protein 2 (PB2) gene, partial cds. |
| gi\|54398656\|AY664809\| | Influenza A virus (A/chicken/HongKong/SSP418/03(H9N2)) polymerase basic protein 2 (PB2) gene, partial cds. |
| gi\|54398658\|AY664810\| | Influenza A virus (A/chicken/HongKong/YU427/03(H9N2)) polymerase basic protein 2 (PB2) gene, partial cds. |
| gi\|55793686\|AY800240\| | Influenza A virus (A/chicken/Korea/S1/2003(H9N2)) polymerase basic protein 2 (PB2) gene, partial cds. |
| gi\|58429686\|AY862710\| | Influenza A virus (A/silky chicken/Korea/S3/03(H9N2)) PB2 (PB2) gene, partial cds. |
| gi\|58429688\|AY862711\| | Influenza A virus (A/chicken/Korea/S4/03(H9N2)) PB2 (PB2) gene, partial cds. |
| gi\|58429690\|AY862712\| | Influenza A virus (A/chicken/Korea/S5/03(H9N2)) PB2 (PB2) gene, partial cds. |
| gi\|58429692\|AY862713\| | Influenza A virus (A/chicken/Korea/S12/03(H9N2)) PB2 (PB2) gene, partial cds. |
| gi\|58429694\|AY862714\| | Influenza A virus (A/duck/Korea/S13/03(H9N2)) PB2 (PB2) gene, partial cds. |
| gi\|58429696\|AY862715\| | Influenza A virus (A/dove/Korea/S14/03(H9N2)) PB2 (PB2) gene, partial cds. |
| gi\|58429698\|AY862716\| | Influenza A virus (A/chicken/Korea/S15/03(H9N2)) PB2 (PB2) gene, partial cds. |
| gi\|58429700\|AY862717\| | Influenza A virus (A/chicken/Korea/S16/03(H9N2)) PB2 (PB2) gene, partial cds. |
| gi\|58429702\|AY862718\| | Influenza A virus (A/chicken/Korea/S18/03(H9N2)) PB2 (PB2) gene, partial cds. |

Sequences used in analysis of Influenza A Polymerase Acidic protein (PA)

| | |
|---|---|
| gi\|27465935\|AY180662\| | Influenza A virus strain A/Quail/Nanchang/12-340/2000 (H1N1) polymerase subunit PA (PA) gene, partial cds. |
| gi\|49357063\|AY633217\| | Influenza A virus (A/mallard/Alberta/211/98(H1N1)) polymerase protein A (PA) gene, partial cds. |
| gi\|5918195\|AJ243994\| | Influenza A virus (STRAIN A/MALLARD/NEW YORK/6750/78) partial mRNA for PA protein. |
| gi\|45272157\|AY422034\| | Influenza A virus (A/duck/Hokkaido/95/01(H2N2)) PA protein (PA) gene, partial cds. |
| gi\|27465965\|AY180677\| | Influenza A virus strain A/Chicken/Nanchang/3-120/2001 (H3N2) polymerase subunit PA (PA) gene, partial cds. |
| gi\|56159994\|AY779263\| | Influenza A virus (A/turkey/North Carolina/12344/03(H3N2)) polymerase acidic protein (PA) gene, partial cds. |
| gi\|56159996\|AY779264\| | Influenza A virus (A/turkey/Minnesota/764-2/03(H3N2)) polymerase acidic protein (PA) gene, partial cds. |
| gi\|58429736\|AY862687\| | Influenza A virus (A/chicken/Korea/S6/03(H3N2)) PA (PA) gene, partial cds. |

TABLE 6-continued

| | |
|---|---|
| gi\|58429738\|AY862688\| | Influenza A virus (A/duck/Korea/S7/03(H3N2)) PA (PA) gene, partial cds. |
| gi\|58429740\|AY862689\| | Influenza A virus (A/duck/Korea/S8/03(H3N2)) PA (PA) gene, partial cds. |
| gi\|58429742\|AY862690\| | Influenza A virus (A/duck/Korea/S9/03(H3N2)) PA (PA) gene, partial cds. |
| gi\|58429744\|AY862691\| | Influenza A virus (A/duck/Korea/S10/03(H3N2)) PA (PA) gene, partial cds. |
| gi\|58429746\|AY862692\| | Influenza A virus (A/dove/Korea/S11/03(H3N2)) PA (PA) gene, partial cds. |
| gi\|18091833\|AF213914\| | Influenza A virus (A/Chicken/Italy/5945/95(H3N2)) segment 3 PA polymerase protein gene, partial cds. |
| gi\|58531086\|AB166861\| | Influenza A virus (A/chicken/Yamaguchi/7/2004(H5N1)) PA gene for polymerase acidic protein, complete cds. |
| gi\|58531118\|AB188815\| | Influenza A virus (A/chicken/Oita/8/2004(H5N1)) PA gene for polymerase acidic protein, complete cds. |
| gi\|9863935\|AF216739\| | Influenza A virus (A/Environment/Hong Kong/437-10/99 (H5N1)) polymerase acidic protein gene, complete cds. |
| gi\|14165201\|AF380163\| | Influenza A virus (A/Goose/Guangdong/3/97(H5N1)) segment 3 polymerase (PA) gene, complete cds. |
| gi\|18092185\|AF398427\| | Influenza A virus (A/Goose/Hong Kong/385.3/2000(H5N1)) polymerase (PA) gene, partial cds. |
| gi\|18092187\|AF398428\| | Influenza A virus (A/Goose/Hong Kong/385.5/2000(H5N1)) polymerase (PA) gene, partial cds. |
| gi\|21359667\|AF468841\| | Influenza A virus (A/Duck/Anyang/AVL-1/2001(H5N1)) polymerase acidic protein (PA) gene, partial cds. |
| gi\|28849710\|AF509195\| | Influenza A virus (A/Chicken/Hong Kong/FY77/01 (H5N1)) polymerase (PA) gene, partial cds. |
| gi\|28849712\|AF509196\| | Influenza A virus (A/Chicken/Hong Kong/YU562/01 (H5N1)) polymerase (PA) gene, partial cds. |
| gi\|28849714\|AF509197\| | Influenza A virus (A/Chicken/Hong Kong/YU563/01 (H5N1)) polymerase (PA) gene, complete cds. |
| gi\|28849716\|AF509198\| | Influenza A virus (A/Chicken/Hong Kong/FY150/01 (H5N1)) polymerase (PA) gene, partial cds. |
| gi\|28849718\|AF509199\| | Influenza A virus (A/Pheasant/Hong Kong/FY155/01 (H5N1)) polymerase (PA) gene, partial cds. |
| gi\|28849720\|AF509200\| | Influenza A virus (A/Silky Chicken/Hong Kong/SF189/01 (H5N1)) polymerase (PA) gene, partial cds. |
| gi\|28849722\|AF509201\| | Influenza A virus (A/Quail/Hong Kong/SF203/01 (H5N1)) polymerase (PA) gene, partial cds. |
| gi\|28849724\|AF509202\| | Influenza A virus (A/Pigeon/Hong Kong/SF215/01 (H5N1)) polymerase (PA) gene, partial cds. |
| gi\|28849726\|AF509203\| | Influenza A virus (A/Chicken/Hong Kong/SF219/01 (H5N1)) polymerase (PA) gene, partial cds. |
| gi\|28849728\|AF509204\| | Influenza A virus (A/Chicken/Hong Kong/715.5/01 (H5N1)) polymerase (PA) gene, partial cds. |
| gi\|28849730\|AF509205\| | Influenza A virus (A/Chicken/Hong Kong/751.1/01 (H5N1)) polymerase (PA) gene, partial cds. |
| gi\|28849732\|AF509206\| | Influenza A virus (A/Chicken/Hong Kong/822.1/01 (H5N1)) polymerase (PA) gene, partial cds. |
| gi\|28849734\|AF509207\| | Influenza A virus (A/Chicken/Hong Kong/829.2/01 (H5N1)) polymerase (PA) gene, partial cds. |
| gi\|28849736\|AF509208\| | Influenza A virus (A/Chicken/Hong Kong/830.2/01 (H5N1)) polymerase (PA) gene, partial cds. |
| gi\|28849738\|AF509209\| | Influenza A virus (A/Chicken/Hong Kong/858.3/01 (H5N1)) polymerase (PA) gene, partial cds. |
| gi\|28849740\|AF509210\| | Influenza A virus (A/Chicken/Hong Kong/866.3/01 (H5N1)) polymerase (PA) gene, partial cds. |
| gi\|28849742\|AF509211\| | Influenza A virus (A/Chicken/Hong Kong/867.1/01 (H5N1)) polymerase (PA) gene, partial cds. |
| gi\|28849744\|AF509212\| | Influenza A virus (A/Chicken/Hong Kong/879.1/01 (H5N1)) polymerase (PA) gene, partial cds. |
| gi\|28849746\|AF509213\| | Influenza A virus (A/Chicken/Hong Kong/873.3/01 (H5N1)) polymerase (PA) gene, partial cds. |
| gi\|28849748\|AF509214\| | Influenza A virus (A/Chicken/Hong Kong/876.1/01 (H5N1)) polymerase (PA) gene, partial cds. |
| gi\|28849750\|AF509215\| | Influenza A virus (A/Chicken/Hong Kong/891.1/01 (H5N1)) polymerase (PA) gene, partial cds. |
| gi\|28849752\|AF509216\| | Influenza A virus (A/Chicken/Hong Kong/893.1/01 (H5N1)) polymerase (PA) gene, partial cds. |
| gi\|28849754\|AF509217\| | Influenza A virus (A/Goose/Hong Kong/76.1/01 (H5N1)) polymerase (PA) gene, partial cds. |
| gi\|28849756\|AF509218\| | Influenza A virus (A/Goose/Hong Kong/ww100/01 (H5N1)) polymerase (PA) gene, partial cds. |
| gi\|28849758\|AF509219\| | Influenza A virus (A/Duck/Hong Kong/573.4/01 (H5N1)) polymerase (PA) gene, partial cds. |
| gi\|28849760\|AF509220\| | Influenza A virus (A/Duck/Hong Kong/646.3/01 (H5N1)) polymerase (PA) gene, partial cds. |
| gi\|19697861\|AY059526\| | Influenza A virus (A/Goose/Hong Kong/ww26/2000(H5N1)) segment 3 polymerase (PA) gene, partial cds. |

TABLE 6-continued

| | |
|---|---|
| gi\|19697863\|AY059527\| | Influenza A virus (A/Goose/Hong Kong/ww28/2000(H5N1)) segment 3 polymerase (PA) gene, partial cds. |
| gi\|19697865\|AY059528\| | Influenza A virus (A/Duck/Hong Kong/ww381/2000(H5N1)) segment 3 polymerase (PA) gene, partial cds. |
| gi\|19697869\|AY059530\| | Influenza A virus (A/Duck/Hong Kong/ww461/2000(H5N1)) segment 3 polymerase (PA) gene, partial cds. |
| gi\|19697871\|AY059531\| | Influenza A virus (A/Goose/Hong Kong/ww491/2000(H5N1)) segment 3 polymerase (PA) gene, partial cds. |
| gi\|19697873\|AY059532\| | Influenza A virus (A/Duck/Hong Kong/2986.1/2000(H5N1)) segment 3 polymerase (PA) gene, partial cds. |
| gi\|19697875\|AY059533\| | Influenza A virus (A/Goose/Hong Kong/3014.8/2000(H5N1)) segment 3 polymerase (PA) gene, partial cds. |
| gi\|28821204\|AY221566\| | Influenza A virus (A/Chicken/HongKong/NT873.3/01-MB(H5N1)) polymerase (PA) gene, partial cds. |
| gi\|28821206\|AY221567\| | Influenza A virus (A/Chicken/HongKong/NT873.3/01(H5N1)) polymerase (PA) gene, partial cds. |
| gi\|28821208\|AY221568\| | Influenza A virus (A/Chicken/HongKong/FY150/01-MB(H5N1)) polymerase (PA) gene, partial cds. |
| gi\|28821210\|AY221569\| | Influenza A virus (A/Chicken/HongKong/FY150/01(H5N1)) polymerase (PA) gene, partial cds. |
| gi\|28821212\|AY221570\| | Influenza A virus (A/Pheasant/HongKong/FY155/01-MB(H5N1)) polymerase (PA) gene, partial cds. |
| gi\|28821214\|AY221571\| | Influenza A virus (A/Pheasant/HongKong/FY155/01(H5N1)) polymerase (PA) gene, partial cds. |
| gi\|28821216\|AY221572\| | Influenza A virus (A/Chicken/HongKong/YU822.2/01-MB(H5N1)) polymerase (PA) gene, partial cds. |
| gi\|28821218\|AY221573\| | Influenza A virus (A/Chicken/HongKong/YU822.2/01(H5N1)) polymerase (PA) gene, partial cds. |
| gi\|28821220\|AY221574\| | Influenza A virus (A/Chicken/HongKong/YU562/01(H5N1)) polymerase (PA) gene, partial cds. |
| gi\|41207483\|AY518365\| | Influenza A virus (A/duck/China/E319-2/03(H5N1)) polymerase (PA) gene, complete cds. |
| gi\|51094114\|AY551934\| | Influenza A virus (A/chicken/Nakorn-Patom Thailand/CU-K2/04(H5N1)) polymerase (PA) gene, complete cds. |
| gi\|47834839\|AY576406\| | Influenza A virus (A/Gs/HK/739.2/02 (H5N1)) polymerase (PA) gene, partial cds. |
| gi\|47834841\|AY576407\| | Influenza A virus (A/Eg/HK/757.3/02 (H5N1)) polymerase (PA) gene, partial cds. |
| gi\|47834843\|AY576408\| | Influenza A virus (A/G.H/HK/793.1/02 (H5N1)) polymerase (PA) gene, partial cds. |
| gi\|47834845\|AY576409\| | Influenza A virus (A/Dk/HK/821/02 (H5N1)) polymerase (PA) gene, partial cds. |
| gi\|47834847\|AY576410\| | Influenza A virus (A/Ck/HK/31.4/02 (H5N1)) polymerase (PA) gene, complete cds. |
| gi\|47834849\|AY576411\| | Influenza A virus (A/Ck/HK/61.9/02 (H5N1)) polymerase (PA) gene, complete cds. |
| gi\|47834851\|AY576412\| | Influenza A virus (A/Ck/HK/YU777/02 (H5N1)) polymerase (PA) gene, complete cds. |
| gi\|47834853\|AY576413\| | Influenza A virus (A/Ck/HK/96.1/02 (H5N1)) polymerase (PA) gene, partial cds. |
| gi\|47834855\|AY576414\| | Influenza A virus (A/Ck/HK/409.1/02 (H5N1)) polymerase (PA) gene, partial cds. |
| gi\|47834857\|AY576415\| | Influenza A virus (A/Ph/HK/sv674.15/02 (H5N1)) polymerase (PA) gene, complete cds. |
| gi\|47156478\|AY585462\| | Influenza A virus (A/duck/Fujian/01/2002(H5N1)) polymerase (PA) mRNA, complete cds. |
| gi\|47156480\|AY585463\| | Influenza A virus (A/duck/Fujian/13/2002(H5N1)) polymerase (PA) mRNA, complete cds. |
| gi\|47156482\|AY585464\| | Influenza A virus (A/duck/Fujian/17/2001(H5N1)) polymerase (PA) mRNA, complete cds. |
| gi\|47156484\|AY585465\| | Influenza A virus (A/duck/Fujian/19/2000(H5N1)) polymerase (PA) mRNA, complete cds. |
| gi\|47156486\|AY585466\| | Influenza A virus (A/duck/Guangdong/01/2001(H5N1)) polymerase (PA) mRNA, complete cds. |
| gi\|47156488\|AY585467\| | Influenza A virus (A/duck/Guangdong/07/2000(H5N1)) polymerase (PA) mRNA, complete cds. |
| gi\|47156490\|AY585468\| | Influenza A virus (A/duck/Guangdong/12/2000(H5N1)) polymerase (PA) mRNA, complete cds. |
| gi\|47156492\|AY585469\| | Influenza A virus (A/duck/Guangdong/22/2002(H5N1)) polymerase (PA) mRNA, complete cds. |
| gi\|47156494\|AY585470\| | Influenza A virus (A/duck/Guangdong/40/2000(H5N1)) polymerase (PA) mRNA, complete cds. |
| gi\|47156496\|AY585471\| | Influenza A virus (A/duck/Guangxi/07/1999(H5N1)) polymerase (PA) mRNA, complete cds. |
| gi\|47156498\|AY585472\| | Influenza A virus (A/duck/Guangxi/22/2001(H5N1)) polymerase (PA) mRNA, complete cds. |
| gi\|47156500\|AY585473\| | Influenza A virus (A/duck/Guangxi/35/2001(H5N1)) polymerase (PA) mRNA, complete cds. |
| gi\|47156502\|AY585474\| | Influenza A virus (A/duck/Guangxi/50/2001(H5N1)) polymerase (PA) mRNA, complete cds. |

TABLE 6-continued

| | |
|---|---|
| gi\|47156504\|AY585475\| | Influenza A virus (A/duck/Guangxi/53/2002(H5N1)) polymerase (PA) mRNA, complete cds. |
| gi\|47156506\|AY585476\| | Influenza A virus (A/duck/Shanghai/08/2001(H5N1)) polymerase (PA) mRNA, complete cds. |
| gi\|47156508\|AY585477\| | Influenza A virus (A/duck/Shanghai/13/2001(H5N1)) polymerase (PA) mRNA, complete cds. |
| gi\|47156510\|AY585478\| | Influenza A virus (A/duck/Shanghai/35/2002(H5N1)) polymerase (PA) mRNA, complete cds. |
| gi\|47156512\|AY585479\| | Influenza A virus (A/duck/Shanghai/37/2002(H5N1)) polymerase (PA) mRNA, complete cds. |
| gi\|47156514\|AY585480\| | Influenza A virus (A/duck/Shanghai/38/2001(H5N1)) polymerase (PA) mRNA, complete cds. |
| gi\|47156516\|AY585481\| | Influenza A virus (A/duck/Zhejiang/11/2000(H5N1)) polymerase (PA) mRNA, complete cds. |
| gi\|47156518\|AY585482\| | Influenza A virus (A/duck/Zhejiang/52/2000(H5N1)) polymerase (PA) mRNA, complete cds. |
| gi\|47716770\|AY609311\| | Influenza A virus (A/chicken/Guangdong/174/04(H5N1)) segment 3, complete sequence. |
| gi\|50313026\|AY651597\| | Influenza A virus (A/Ck/Indonesia/4/2004(H5N1)) polymerase acidic protein (PA) gene, partial cds. |
| gi\|50313028\|AY651598\| | Influenza A virus (A/Ck/Indonesia/5/2004(H5N1)) polymerase acidic protein (PA) gene, partial cds. |
| gi\|50313030\|AY651599\| | Influenza A virus (A/Ck/Indonesia/2A/2003(H5N1)) polymerase acidic protein (PA) gene, partial cds. |
| gi\|50313032\|AY651600\| | Influenza A virus (A/Dk/Indonesia/MS/2004(H5N1)) polymerase acidic protein (PA) gene, partial cds. |
| gi\|50313034\|AY651601\| | Influenza A virus (A/Ck/Indonesia/BL/2003(H5N1)) polymerase acidic protein (PA) gene, partial cds. |
| gi\|50313036\|AY651602\| | Influenza A virus (A/Ck/Indonesia/PA/2003(H5N1)) polymerase acidic protein (PA) gene, partial cds. |
| gi\|50313038\|AY651603\| | Influenza A virus (A/Ck/Thailand/1/2004(H5N1)) polymerase acidic protein (PA) gene, partial cds. |
| gi\|50313040\|AY651604\| | Influenza A virus (A/Ck/Thailand/73/2004(H5N1)) polymerase acidic protein (PA) gene, partial cds. |
| gi\|50313042\|AY651605\| | Influenza A virus (A/Ck/Thailand/9.1/2004(H5N1)) polymerase acidic protein (PA) gene, partial cds. |
| gi\|50313044\|AY651606\| | Influenza A virus (A/Qa/Thailand/57/2004(H5N1)) polymerase acidic protein (PA) gene, partial cds. |
| gi\|50313046\|AY651607\| | Influenza A virus (A/bird/Thailand/3.1/2004(H5N1)) polymerase acidic protein (PA) gene, partial cds. |
| gi\|50313048\|AY651608\| | Influenza A virus (A/Dk/Thailand/71.1/2004(H5N1)) polymerase acidic protein (PA) gene, partial cds. |
| gi\|50313050\|AY651609\| | Influenza A virus (A/Gs/Thailand/79/2004(H5N1)) polymerase acidic protein (PA) gene, partial cds. |
| gi\|50313060\|AY651614\| | Influenza A virus (A/Ck/Viet Nam/33/2004(H5N1)) polymerase acidic protein (PA) gene, partial cds. |
| gi\|50313062\|AY651615\| | Influenza A virus (A/Ck/Viet Nam/35/2004(H5N1)) polymerase acidic protein (PA) gene, partial cds. |
| gi\|50313064\|AY651616\| | Influenza A virus (A/Ck/Viet Nam/36/2004(H5N1)) polymerase acidic protein (PA) gene, partial cds. |
| gi\|50313066\|AY651617\| | Influenza A virus (A/Ck/Viet Nam/37/2004(H5N1)) polymerase acidic protein (PA) gene, partial cds. |
| gi\|50313068\|AY651618\| | Influenza A virus (A/Ck/Viet Nam/38/2004(H5N1)) polymerase acidic protein (PA) gene, partial cds. |
| gi\|50313070\|AY651619\| | Influenza A virus (A/Ck/Viet Nam/39/2004(H5N1)) polymerase acidic protein (PA) gene, partial cds. |
| gi\|50313072\|AY651620\| | Influenza A virus (A/Ck/Viet Nam/C57/2004(H5N1)) polymerase acidic protein (PA) gene, partial cds. |
| gi\|50313074\|AY651621\| | Influenza A virus (A/Dk/Viet Nam/11/2004(H5N1)) polymerase acidic protein (PA) gene, partial cds. |
| gi\|50313076\|AY651622\| | Influenza A virus (A/Gf/HK/38/2002(H5N1)) polymerase acidic protein (PA) gene, complete cds. |
| gi\|50313078\|AY651623\| | Influenza A virus (A/Ck/HK/31.2/2002(H5N1)) polymerase acidic protein (PA) gene, complete cds. |
| gi\|50313080\|AY651624\| | Influenza A virus (A/Ck/HK/37.4/2002(H5N1)) polymerase acidic protein (PA) gene, partial cds. |
| gi\|50313082\|AY651625\| | Influenza A virus (A/SCk/HK/YU100/2002(H5N1)) polymerase acidic protein (PA) gene, complete cds. |
| gi\|50313084\|AY651626\| | Influenza A virus (A/Ck/HK/YU22/2002(H5N1)) polymerase acidic protein (PA) gene, partial cds. |
| gi\|50313086\|AY651627\| | Influenza A virus (A/Ck/HK/3176.3/2002(H5N1)) polymerase acidic protein (PA) gene, partial cds. |
| gi\|50313088\|AY651628\| | Influenza A virus (A/Ck/HK/3169.1/2002(H5N1)) polymerase acidic protein (PA) gene, partial cds. |
| gi\|50313090\|AY651629\| | Influenza A virus (A/Ck/HK/FY157/2003(H5N1)) polymerase acidic protein (PA) gene, partial cds. |
| gi\|50313092\|AY651630\| | Influenza A virus (A/Ck/HK/YU324/2003(H5N1)) polymerase acidic protein (PA) gene, partial cds. |
| gi\|50313094\|AY651631\| | Influenza A virus (A/Ck/HK/2133.1/2003(H5N1)) polymerase acidic protein (PA) gene, partial cds. |

TABLE 6-continued

| | |
|---|---|
| gi\|50313096\|AY651632\| | Influenza A virus (A/Ck/HK/NT93/2003(H5N1)) polymerase acidic protein (PA) gene, partial cds. |
| gi\|50313098\|AY651633\| | Influenza A virus (A/Ck/HK/SSP141/2003(H5N1)) polymerase acidic protein (PA) gene, partial cds. |
| gi\|50313100\|AY651634\| | Influenza A virus (A/Ck/HK/WF157/2003(H5N1)) polymerase acidic protein (PA) gene, partial cds. |
| gi\|50313102\|AY651635\| | Influenza A virus (A/black headed gull/HK/12.1/2003(H5N1)) polymerase acidic protein (PA) gene, partial cds. |
| gi\|50313104\|AY651636\| | Influenza A virus (A/grey heron/HK/861.1/2002(H5N1)) polymerase acidic protein (PA) gene, partial cds. |
| gi\|50313106\|AY651637\| | Influenza A virus (A/feral pigeon/HK/862.7/2002(H5N1)) polymerase acidic protein (PA) gene, partial cds. |
| gi\|50313108\|AY651638\| | Influenza A virus (A/tree sparrow/HK/864/2002(H5N1)) polymerase acidic protein (PA) gene, partial cds. |
| gi\|50313110\|AY651639\| | Influenza A virus (A/teal/China/2978.1/2002(H5N1)) polymerase acidic protein (PA) gene, partial cds. |
| gi\|50313112\|AY651640\| | Influenza A virus (A/peregrine falcon/HK/D0028/2004(H5N1)) polymerase acidic protein (PA) gene, partial cds. |
| gi\|50313114\|AY651641\| | Influenza A virus (A/Dk/HN/5806/2003(H5N1)) polymerase acidic protein (PA) gene, partial cds. |
| gi\|50313116\|AY651642\| | Influenza A virus (A/Dk/HN/303/2004(H5N1)) polymerase acidic protein (PA) gene, partial cds. |
| gi\|50313118\|AY651643\| | Influenza A virus (A/Dk/HN/101/2004(H5N1)) polymerase acidic protein (PA) gene, partial cds. |
| gi\|50313120\|AY651644\| | Influenza A virus (A/Dk/ST/4003/2003(H5N1)) polymerase acidic protein (PA) gene, partial cds. |
| gi\|50313122\|AY651645\| | Influenza A virus (A/Ph/ST/44/2004(H5N1)) polymerase acidic protein (PA) gene, partial cds. |
| gi\|50313124\|AY651646\| | Influenza A virus (A/Ck/ST/4231/2003(H5N1)) polymerase acidic protein (PA) gene, partial cds. |
| gi\|50313126\|AY651647\| | Influenza A virus (A/Dk/YN/6255/2003(H5N1)) polymerase acidic protein (PA) gene, partial cds. |
| gi\|50313128\|AY651648\| | Influenza A virus (A/Dk/YN/6445/2003(H5N1)) polymerase acidic protein (PA) gene, partial cds. |
| gi\|50313130\|AY651649\| | Influenza A virus (A/Ck/YN/115/2004(H5N1)) polymerase acidic protein (PA) gene, partial cds. |
| gi\|50313132\|AY651650\| | Influenza A virus (A/Ck/YN/374/2004(H5N1)) polymerase acidic protein (PA) gene, partial cds. |
| gi\|50365724\|AY653198\| | Influenza A virus (A/chicken/Jilin/9/2004(H5N1)) segment 3, complete sequence. |
| gi\|56548923\|AY676029\| | Influenza A virus (A/duck/Hong Kong/821/02(H5N1)) polymerase (PA) gene, complete cds. |
| gi\|56548925\|AY676030\| | Influenza A virus (A/egret/Hong Kong/757.2/03(H5N1)) polymerase (PA) gene, complete cds. |
| gi\|56548927\|AY676031\| | Influenza A virus (A/chicken/Korea/ES/03(H5N1)) polymerase (PA) gene, complete cds. |
| gi\|56548929\|AY676032\| | Influenza A virus (A/duck/Korea/ESD1/03(H5N1)) polymerase (PA) gene, complete cds. |
| gi\|50956625\|AY684705\| | Influenza A virus (A/chicken/Hubei/327/2004(H5N1)) polymerase (PA) gene, complete cds. |
| gi\|56119221\|AY720944\| | Influenza A virus (A/chicken/Viet Nam/DT-171/2004(H5N1)) polymerase acidic protein (PA) gene, partial cds. |
| gi\|56119227\|AY720947\| | Influenza A virus (A/duck/Viet Nam/TG-007A/2004(H5N1)) polymerase acidic protein (PA) gene, partial cds. |
| gi\|57924419\|AY724784\| | Influenza A virus (A/chicken/Viet Nam/HCM-022/2004(H5N1)) polymerase (PA) gene, partial cds. |
| gi\|57924480\|AY724786\| | Influenza A virus (A/chicken/Viet Nam/DN-045/2004(H5N1)) polymerase (PA) gene, partial cds. |
| gi\|57924569\|AY724788\| | Influenza A virus (A/chicken/Viet Nam/VL-008/2004(H5N1)) polymerase (PA) gene, partial cds. |
| gi\|57924680\|AY724790\| | Influenza A virus (A/chicken/Viet Nam/AG-010/2004(H5N1)) polymerase (PA) gene, partial cds. |
| gi\|57924765\|AY724792\| | Influenza A virus (A/chicken/Viet Nam/DT-015/2004(H5N1)) polymerase (PA) gene, partial cds. |
| gi\|57924882\|AY724796\| | Influenza A virus (A/chicken/Viet Nam/LA-024/2004(H5N1)) polymerase (PA) gene, partial cds. |
| gi\|57915971\|AY737288\| | Influenza A virus (A/chicken/Guangdong/191/04(H5N1)) segment 3, complete sequence. |
| gi\|57916018\|AY737295\| | Influenza A virus (A/chicken/Guangdong/178/04(H5N1)) segment 3, complete sequence. |
| gi\|57916074\|AY737303\| | Influenza A virus (A/duck/Guangdong/173/04(H5N1)) segment 3, complete sequence. |
| gi\|55233234\|AY770082\| | Influenza A virus (A/chicken/Hubei/489/2004(H5N1)) polymerase (PA) gene, complete cds. |
| gi\|54873465\|AY770995\| | Influenza A virus (A/chicken/Ayutthaya/Thailand/CU-23/04(H5N1)) polymerase gene, partial cds. |
| gi\|58618433\|AY818133\| | Influenza A virus (A/chicken/Vietnam/C58/04(H5N1)) polymerase protein PA gene, complete cds. |

TABLE 6-continued

| | |
|---|---|
| gi\|58618435\|AY818134\| | Influenza A virus (A/quail/Vietnam/36/04(H5N1)) polymerase protein PA gene, complete cds. |
| gi\|58374187\|AY856863\| | Influenza A virus (A/duck/Shandong/093/2004(H5N1)) segment 3, complete sequence. |
| gi\|58531136\|AB188823\| | Influenza A virus (A/chicken/Kyoto/3/2004(H5N1)) PA gene for polymerase acidic protein, complete cds. |
| gi\|58531154\|AB189052\| | Influenza A virus (A/crow/Kyoto/53/2004(H5N1)) PA gene for polymerase acidic protein, complete cds,. |
| gi\|58531170\|AB189059\| | Influenza A virus (A/crow/Osaka/102/2004(H5N1)) PA gene for polymerase acidic protein, complete cds,. |
| gi\|3335418\|AF046087\| | Influenza A virus (A/Chicken/Hong Kong/220/97 (H5N1)) polymerase acidic protein (PA) gene, partial cds. |
| gi\|6048895\|AF098604\| | Influenza A virus (A/Chicken/Hong Kong/258/97 (H5N1)) PA protein (PA) gene, complete cds. |
| gi\|6048897\|AF098605\| | Influenza A virus (A/Chicken/Hong Kong/y388/97 (H5N1)) PA protein (PA) gene, complete cds. |
| gi\|6048899\|AF098606\| | Influenza A virus (A/Chicken/Hong Kong/728/97 (H5N1)) PA protein (PA) gene, complete cds. |
| gi\|6048901\|AF098607\| | Influenza A virus (A/Chicken/Hong Kong/786/97 (H5N1)) PA protein (PA) gene, complete cds. |
| gi\|6048903\|AF098608\| | Influenza A virus (A/Chicken/Hong Kong/915/97 (H5N1)) PA protein (PA) gene, complete cds. |
| gi\|6048905\|AF098609\| | Influenza A virus (A/Duck/Hong Kong/p46/97 (H5N1)) PA protein (PA) gene, complete cds. |
| gi\|6048907\|AF098610\| | Influenza A virus (A/Duck/Hong Kong/y283/97 (H5N1)) PA protein (PA) gene, complete cds. |
| gi\|6048909\|AF098611\| | Influenza A virus (A/Goose/Hong Kong/w355/97 (H5N1)) PA protein (PA) gene, complete cds. |
| gi\|5805280\|AF144302\| | Influenza A virus (A/Goose/Guangdong/1/96(H5N1)) polymerase (PA) gene, complete cds. |
| gi\|9863880\|AF216715\| | Influenza A virus (A/Environment/Hong Kong/437-4/99 (H5N1)) polymerase acidic protein gene, complete cds. |
| gi\|9863899\|AF216723\| | Influenza A virus (A/Environment/Hong Kong/437-6/99 (H5N1)) polymerase acidic protein gene, complete cds. |
| gi\|9863917\|AF216731\| | Influenza A virus (A/Environment/Hong Kong/437-8/99 (H5N1)) polymerase acidic protein gene, complete cds. |
| gi\|34597776\|AY303660\| | Influenza A virus (A/chicken/Chile/176822/02(H7N3)) polymerase acidic protein gene, complete cds. |
| gi\|34597778\|AY303661\| | Influenza A virus (A/chicken/Chile/4957/02(H7N3)) polymerase acidic protein gene, complete cds. |
| gi\|34597780\|AY303662\| | Influenza A virus (A/chicken/Chile/4322/02(H7N3)) polymerase acidic protein gene, partial cds. |
| gi\|47680912\|AY586431\| | Influenza A Virus (A/mallard/Italy/43/01(H7N3)) PA gene, partial cds. |
| gi\|47680914\|AY586432\| | Influenza A virus (A/mallard/Italy/33/01(H7N3)) PA gene, partial cds. |
| gi\|47680916\|AY586433\| | Influenza A virus (A/turkey/Italy/220158/2002(H7N3)) PA gene, partial cds. |
| gi\|47680918\|AY586434\| | Influenza A Virus (A/turkey/Italy/214845/02(H7N3)) PA gene, partial cds. |
| gi\|47834370\|AY616764\| | Influenza A virus (A/chicken/British Columbia/04(H7N3)) polymerase acidic protein 2 (PA) gene, complete cds. |
| gi\|50542647\|AY646083\| | Influenza A virus (A/chicken/British Columbia/GSC_human_B/04(H7N3)) polymerase acidic protein 2 (PA) gene, complete cds. |
| gi\|50083049\|AY648292\| | Influenza A virus (A/GSC_chicken_B/British Columbia/04(H7N3)) polymerase acidic protein 2 (PA) gene, complete cds. |
| gi\|50059192\|AY650275\| | Influenza A virus (A/GSC_chicken/British Columbia/04(H7N3)) polymerase acidic protein 2 (PA) gene, complete cds. |
| gi\|9988639\|AF268109\| | Influenza A virus (A/RedKnot/Delaware/259/94(H7N7)) polymerase protein PA gene, partial cds. |
| gi\|40353080\|AJ619677\| | Influenza A virus (A/chicken/Germany/R28/03(H7N7)) PA gene for polymerase complex subunit PA, genomic RNA. |
| gi\|37813167\|AY342415\| | Influenza A virus (A/Netherlands/124/03(H7N7)) polymerase protein A gene, partial cds. |
| gi\|37813169\|AY342416\| | Influenza A virus (A/Netherlands/126/03(H7N7)) polymerase protein A gene, partial cds. |
| gi\|37813171\|AY342417\| | Influenza A virus (A/Netherlands/127/03(H7N7)) polymerase protein A gene, partial cds. |
| gi\|37813173\|AY342418\| | Influenza A virus (A/Netherlands/219/03(H7N7)) polymerase protein A gene, complete cds. |
| gi\|37813175\|AY342419\| | Influenza A virus (A/Netherlands/033/03(H7N7)) polymerase protein A gene, complete cds. |
| gi\|37813177\|AY342420\| | Influenza A virus (A/chicken/Netherlands/1/03(H7N7)) polymerase protein A gene, complete cds. |
| gi\|13383274\|AB049157\| | Influenza A virus (A/parakeet/Chiba/1/97(H9N2)) PA gene for polymerase acidic protein, complete cds. |
| gi\|13383276\|AB049158\| | Influenza A virus (A/parakeet/Narita/92A/98(H9N2)) PA gene for polymerase acidic protein, complete cds. |

TABLE 6-continued

| | |
|---|---|
| gi\|33318154\|AF508662\| | Influenza A virus (A/Ostrich/South Africa/9508103/95(H9N2)) segment 3 polymerase PA (PA) gene, complete cds. |
| gi\|33318156\|AF508663\| | Influenza A virus (A/Chicken/Pakistan/4/99(H9N2)) segment 3 polymerase PA (PA) gene, complete cds. |
| gi\|33318158\|AF508664\| | Influenza A virus (A/Chicken/Pakistan/5/99(H9N2)) segment 3 polymerase PA (PA) gene, partial cds. |
| gi\|33318160\|AF508665\| | Influenza A virus (A/Chicken/Germany/R45/98(H9N2)) segment 3 polymerase PA (PA) gene, complete cds. |
| gi\|33318162\|AF508666\| | Influenza A virus (A/Duck/Germany/113/95(H9N2)) segment 3 polymerase PA (PA) gene, complete cds. |
| gi\|33318164\|AF508667\| | Influenza A virus (A/Chicken/Iran/11T/99(H9N2)) segment 3 polymerase PA (PA) gene, partial cds. |
| gi\|33318166\|AF508668\| | Influenza A virus (A/Chicken/Saudi Arabia/532/99(H9N2)) segment 3 polymerase PA (PA) gene, complete cds. |
| gi\|33318168\|AF508669\| | Influenza A virus (A/Pheasant/Ireland/PV18/97(H9N2)) segment 3 polymerase PA (PA) gene, complete cds. |
| gi\|33318170\|AF508670\| | Influenza A virus (A/Chicken/Korea/99029/99(H9N2)) segment 3 polymerase PA (PA) gene, complete cds. |
| gi\|33318172\|AF508671\| | Influenza A virus (A/Chicken/Beijing/8/98(H9N2)) segment 3 polymerase PA (PA) gene, complete cds. |
| gi\|33318174\|AF508672\| | Influenza A virus (A/Chicken/Guangdong/10/00(H9N2)) segment 3 polymerase PA (PA) gene, complete cds. |
| gi\|33318176\|AF508673\| | Influenza A virus (A/Chicken/Guangdong/11/97(H9N2)) segment 3 polymerase PA (PA) gene, complete cds. |
| gi\|33318178\|AF508674\| | Influenza A virus (A/Chicken/Hebei/4/98(H9N2)) segment 3 polymerase PA (PA) gene, complete cds. |
| gi\|33318180\|AF508675\| | Influenza A virus (A/Chicken/Heilongjiang/10/97(H9N2)) segment 3 polymerase PA (PA) gene, complete cds. |
| gi\|33318182\|AF508676\| | Influenza A virus (A/Chicken/Henan/62/00(H9N2)) segment 3 polymerase PA (PA) gene, partial cds. |
| gi\|33318184\|AF508677\| | Influenza A virus (A/Chicken/Ningxia/5/99(H9N2)) segment 3 polymerase PA (PA) gene, complete cds. |
| gi\|33318186\|AF508678\| | Influenza A virus (A/Chicken/Sichuan/5/97(H9N2)) segment 3 polymerase PA (PA) gene, complete cds. |
| gi\|33318188\|AF508679\| | Influenza A virus (A/Chicken/Shandong/6/96(H9N2)) segment 3 polymerase PA (PA) gene, partial cds. |
| gi\|33318190\|AF508680\| | Influenza A virus (A/Chicken/Shijiazhuang/2/99(H9N2)) segment 3 polymerase PA (PA) gene, partial cds. |
| gi\|33318192\|AF508681\| | Influenza A virus (A/Chicken/Shenzhen/9/97(H9N2)) segment 3 polymerase PA (PA) gene, complete cds. |
| gi\|33318194\|AF508682\| | Influenza A virus (A/Duck/Nanjing/1/97(H9N2)) segment 3 polymerase PA (PA) gene, complete cds. |
| gi\|33318196\|AF508683\| | Influenza A virus (A/Quail/Shanghai/8/96(H9N2)) segment 3 polymerase PA (PA) gene, partial cds. |
| gi\|31339541\|AF523446\| | Influenza A virus (A/Duck/Shantou/1043/00(H9N2)) polymerase (PA) gene, partial cds. |
| gi\|31339543\|AF523447\| | Influenza A virus (A/Duck/Shantou/1042/00(H9N2)) polymerase (PA) gene, partial cds. |
| gi\|31339545\|AF523448\| | Influenza A virus (A/Duck/Shantou/2088/01(H9N2)) polymerase (PA) gene, partial cds. |
| gi\|31339547\|AF523449\| | Influenza A virus (A/Duck/Shantou/830/00(H9N2)) polymerase (PA) gene, partial cds. |
| gi\|31339549\|AF523450\| | Influenza A virus (A/Duck/Shantou/1796/00(H9N2)) polymerase (PA) gene, partial cds. |
| gi\|31339551\|AF523451\| | Influenza A virus (A/Duck/Shantou/2143/00(H9N2)) polymerase (PA) gene, partial cds. |
| gi\|31339553\|AF523452\| | Influenza A virus (A/Duck/Shantou/2134/00(H9N2)) polymerase (PA) gene, partial cds. |
| gi\|31339555\|AF523453\| | Influenza A virus (A/Duck/Shantou/2144/00(H9N2)) polymerase (PA) gene, partial cds. |
| gi\|31339557\|AF523454\| | Influenza A virus (A/Wild Duck/Shantou/4808/01(H9N2)) polymerase (PA) gene, partial cds. |
| gi\|31339559\|AF523455\| | Influenza A virus (A/Duck/Shantou/1881/00(H9N2)) polymerase (PA) gene, partial cds. |
| gi\|31339561\|AF523456\| | Influenza A virus (A/Duck/Shantou/2102/00(H9N2)) polymerase (PA) gene, partial cds. |
| gi\|31339563\|AF523457\| | Influenza A virus (A/Duck/Hong Kong/289/78(H9N2)) polymerase (PA) gene, partial cds. |
| gi\|31339565\|AF523458\| | Influenza A virus (A/Duck/Hong Kong/610/79(H9N2)) polymerase (PA) gene, partial cds. |
| gi\|31339567\|AF523459\| | Influenza A virus (A/Duck/Hong Kong/86/76(H9N2)) polymerase (PA) gene, partial cds. |
| gi\|31339569\|AF523460\| | Influenza A virus (A/Duck/Hong Kong/366/78(H9N2)) polymerase (PA) gene, partial cds. |
| gi\|22759040\|AF536669\| | Influenza A virus (A/Chicken/Beijing/1/95(H9N2)) PA gene, partial cds. |
| gi\|22759042\|AF536670\| | Influenza A virus (A/Chicken/Beijing/2/97(H9N2)) PA gene, partial cds. |

TABLE 6-continued

| | |
|---|---|
| gi\|22759044\|AF536671\| | Influenza A virus (A/Chicken/Beijing/3/99(H9N2)) PA gene, partial cds. |
| gi\|22759046\|AF536672\| | Influenza A virus (A/Chicken/Guangdong/97(H9N2)) PA gene, partial cds. |
| gi\|22759048\|AF536673\| | Influenza A virus (A/Chicken/Hebei/1/96(H9N2)) PA gene, partial cds. |
| gi\|22759050\|AF536674\| | Influenza A virus (A/Chicken/Hebei/2/98(H9N2)) PA gene, partial cds. |
| gi\|22759052\|AF536675\| | Influenza A virus (A/Chicken/Hebei/3/98(H9N2)) PA gene, partial cds. |
| gi\|22759054\|AF536676\| | Influenza A virus (A/Chicken/Henan/98(H9N2)) PA gene, partial cds. |
| gi\|22759056\|AF536677\| | Influenza A virus (A/Chicken/Liaoning/99(H9N2)) PA gene, partial cds. |
| gi\|22759058\|AF536678\| | Influenza A virus (A/Chicken/Shandong/98(H9N2)) PA gene, partial cds. |
| gi\|12038897\|AJ291397\| | Influenza A virus (A/Chicken/Pakistan/2/99 (H9N2)) PA gene for polymerase PA, genomic RNA. |
| gi\|18496121\|AJ427863\| | Influenza A virus (A/quail/Hong Kong/FY298/00 (H9N2)) partial pa gene for PA polymerase protein, genomic RNA |
| gi\|27465911\|AY180650\| | Influenza A virus strain A/Duck/Nanchang/11-392/2000 (H9N2) polymerase subunit PA (PA) gene, partial cds. |
| gi\|27465913\|AY180651\| | Influenza A virus strain A/Duck/Nanchang/11-290/2000 (H9N2) polymerase subunit PA (PA) gene, partial cds. |
| gi\|27465915\|AY180652\| | Influenza A virus strain A/Chicken/Nanchang/1-0016/2000 (H9N2) polymerase subunit PA (PA) gene, partial cds. |
| gi\|27465917\|AY180653\| | Influenza A virus strain A/Duck/Nanchang/11-197/2000 (H9N2) polymerase subunit PA (PA) gene, partial cds. |
| gi\|27465937\|AY180663\| | Influenza A virus strain A/Pigeon/Nanchang/2-0461/2000 (H9N2) polymerase subunit PA (PA) gene, partial cds. |
| gi\|27465941\|AY180665\| | Influenza A virus strain A/Chicken/Nanchang/4-301/2001 (H9N2) polymerase subunit PA (PA) gene, partial cds. |
| gi\|27465943\|AY180666\| | Influenza A virus strain A/Chicken/Nanchang/4-361/2001 (H9N2) polymerase subunit PA (PA) gene, partial cds. |
| gi\|27465961\|AY180675\| | Influenza A virus strain A/Wild Duck/Nanchang/2-0480/2000 (H9N2) polymerase subunit PA (PA) gene, partial cds. |
| gi\|27465983\|AY180686\| | Influenza A virus strain A/Duck/Nanchang/1-0070/2000 (H9N2) polymerase subunit PA (PA) gene, partial cds. |
| gi\|27465989\|AY180689\| | Influenza A virus strain A/Duck/Nanchang/10-389/2000 (H9N2) polymerase subunit PA (PA) gene, partial cds. |
| gi\|27465993\|AY180691\| | Influenza A virus strain A/Pigeon/Nanchang/11-145/2000 (H9N2) polymerase subunit PA (PA) gene, partial cds. |
| gi\|27466001\|AY180695\| | Influenza A virus strain A/Quail/Nanchang/2-0460/2000 (H9N2) polymerase subunit PA (PA) gene, partial cds. |
| gi\|27466003\|AY180696\| | Influenza A virus strain A/Quail/Nanchang/4-040/2000 (H9N2) polymerase subunit PA (PA) gene, partial cds. |
| gi\|27466009\|AY180699\| | Influenza A virus strain A/Chicken/Nanchang/4-010/2000 (H9N2) polymerase subunit PA (PA) gene, partial cds. |
| gi\|27466015\|AY180702\| | Influenza A virus strain A/Duck/Nanchang/7-092/2000 (H9N2) polymerase subunit PA (PA) gene, partial cds. |
| gi\|27466019\|AY180704\| | Influenza A virus strain A/Pigeon/Nanchang/7-058/2000 (H9N2) polymerase subunit PA (PA) gene, partial cds. |
| gi\|30025973\|AY253752\| | Influenza A virus (A/Chicken/Shanghai/F/98(H9N2)) polymerase acidic protein (PA) gene, complete cds. |
| gi\|49357051\|AY633169\| | Influenza A virus (A/mallard/Alberta/17/91(H9N2)) polymerase protein A (PA) gene, partial cds. |
| gi\|49357079\|AY633281\| | Influenza A virus (A/mallard/Alberta/321/88(H9N2)) polymerase protein A (PA) gene, partial cds. |
| gi\|49357083\|AY633297\| | Influenza A virus (A/mallard/Alberta/11/91(H9N2)) polymerase protein A (PA) gene, partial cds. |
| gi\|54301528\|AY664755\| | Influenza A virus (A/chicken/HongKong/CSW153/03(H9N2)) polymerase acidic protein (PA) gene, partial cds. |
| gi\|54301530\|AY664756\| | Influenza A virus (A/chicken/HongKong/AP45/03(H9N2)) polymerase acidic protein (PA) gene, partial cds. |
| gi\|54301532\|AY664757\| | Influenza A virus (A/chicken/HongKong/BD90/03(H9N2)) polymerase acidic protein (PA) gene, partial cds. |
| gi\|54301534\|AY664758\| | Influenza A virus (A/chicken/HongKong/CSW291/03(H9N2)) polymerase acidic protein (PA) gene, partial cds. |
| gi\|54301536\|AY664759\| | Influenza A virus (A/chicken/HongKong/CSW304/03(H9N2)) polymerase acidic protein (PA) gene, partial cds. |
| gi\|54301538\|AY664760\| | Influenza A virus (A/chicken/HongKong/FY23/03(H9N2)) polymerase acidic protein (PA) gene, partial cds. |
| gi\|54301540\|AY664761\| | Influenza A virus (A/guineafowl/HongKong/NT101/03(H9N2)) polymerase acidic protein (PA) gene, partial cds. |
| gi\|54301542\|AY664762\| | Influenza A virus (A/chicken/HongKong/NT142/03(H9N2)) polymerase acidic protein (PA) gene, partial cds. |

TABLE 6-continued

| | |
|---|---|
| gi\|54301544\|AY664763\| | Influenza A virus (A/chicken/HongKong/SF1/03(H9N2)) polymerase acidic protein (PA) gene, partial cds. |
| gi\|54301546\|AY664764\| | Influenza A virus (A/chicken/HongKong/SSP101/03(H9N2)) polymerase acidic protein (PA) gene, partial cds. |
| gi\|54301548\|AY664765\| | Influenza A virus (A/chicken/HongKong/TP38/03(H9N2)) polymerase acidic protein-like (PA) gene, complete sequence. |
| gi\|54301549\|AY664766\| | Influenza A virus (A/chicken/HongKong/WF126/03(H9N2)) polymerase acidic protein (PA) gene, partial cds. |
| gi\|54301551\|AY664767\| | Influenza A virus (A/pigeon/HongKong/WF53/03(H9N2)) polymerase acidic protein (PA) gene, partial cds. |
| gi\|54301553\|AY664768\| | Influenza A virus (A/pheasant/HongKong/WF54/03(H9N2)) polymerase acidic protein (PA) gene, partial cds. |
| gi\|54301555\|AY664769\| | Influenza A virus (A/guineafowl/HongKong/NT184/03(H9N2)) polymerase acidic protein (PA) gene, partial cds. |
| gi\|54301557\|AY664770\| | Influenza A virus (A/chicken/HongKong/WF120/03(H9N2)) polymerase acidic protein (PA) gene, partial cds. |
| gi\|54301559\|AY664771\| | Influenza A virus (A/chicken/HongKong/NT366/03(H9N2)) polymerase acidic protein (PA) gene, partial cds. |
| gi\|54301561\|AY664772\| | Influenza A virus (A/chicken/HongKong/SSP418/03(H9N2)) polymerase acidic protein (PA) gene, partial cds. |
| gi\|54301563\|AY664773\| | Influenza A virus (A/chicken/HongKong/YU427/03(H9N2)) polymerase acidic protein (PA) gene, partial cds. |
| gi\|55793682\|AY800238\| | Influenza A virus (A/chicken/Korea/S1/2003(H9N2)) polymerase acidic protein (PA) gene, complete cds. |
| gi\|58429718\|AY862678\| | Influenza A virus (A/silky chicken/Korea/S3/03(H9N2)) PA (PA) gene, partial cds. |
| gi\|58429720\|AY862679\| | Influenza A virus (A/chicken/Korea/S4/03(H9N2)) PA (PA) gene, partial cds. |
| gi\|58429722\|AY862680\| | Influenza A virus (A/chicken/Korea/S5/03(H9N2)) PA (PA) gene, complete cds. |
| gi\|58429724\|AY862681\| | Influenza A virus (A/chicken/Korea/S12/03(H9N2)) PA (PA) gene, partial cds. |
| gi\|58429726\|AY862682\| | Influenza A virus (A/duck/Korea/S13/03(H9N2)) PA (PA) gene, partial cds. |
| gi\|58429728\|AY862683\| | Influenza A virus (A/dove/Korea/S14/03(H9N2)) PA (PA) gene, partial cds. |
| gi\|58429730\|AY862684\| | Influenza A virus (A/chicken/Korea/S15/03(H9N2)) PA (PA) gene, partial cds. |
| gi\|58429732\|AY862685\| | Influenza A virus (A/chicken/Korea/S16/03(H9N2)) PA (PA) gene, partial cds. |
| gi\|58429734\|AY862686\| | Influenza A virus (A/chicken/Korea/S18/03(H9N2)) PA (PA) gene, partial cds. |
| gi\|5732356\|AF156444\| | Influenza A virus (A/Chicken/Hong Kong/G9/97(H9N2)) segment 3 polymerase (PA) gene, partial cds. |
| gi\|5732358\|AF156445\| | Influenza A virus (A/Chicken/Hong Kong/G23/97(H9N2)) segment 3 polymerase (PA) gene, complete cds. |
| gi\|5732360\|AF156446\| | Influenza A virus (A/Pigeon/Hong Kong/Y233/97(H9N2)) segment 3 polymerase (PA) gene, partial cds. |
| gi\|5732362\|AF156447\| | Influenza A virus (A/Duck/Hong Kong/Y280/97(H9N2)) segment 3 polymerase (PA) gene, partial cds. |
| gi\|5732364\|AF156448\| | Influenza A virus (A/Duck/Hong Kong/Y439/97(H9N2)) segment 3 polymerase (PA) gene, partial cds. |
| gi\|5732366\|AF156449\| | Influenza A virus (A/Quail/Hong Kong/G1/97 (H9N2)) segment 3 polymerase (PA) gene, partial cds. |
| gi\|5732368\|AF156450\| | Influenza A virus (A/Chicken/Hong Kong/739/94(H9N2)) segment 3 polymerase (PA) gene, partial cds. |
| gi\|5732370\|AF156451\| | Influenza A virus (A/Quail/Hong Kong/AF157/92(H9N2)) segment 3 polymerase (PA) gene, partial cds. |
| gi\|5732372\|AF156452\| | Influenza A virus (A/Chicken/Beijing/1/94(H9N2)) segment 3 polymerase (PA) gene, partial cds. |
| gi\|5732374\|AF156453\| | Influenza A virus (A/Chicken/Korea/38349-p96323/96(H9N2)) segment 3 polymerase (PA) gene, partial cds. |
| gi\|5732376\|AF156454\| | Influenza A virus (A/Chicken/Korea/25232-96006/96(H9N2)) segment 3 polymerase (PA) gene, partial cds. |
| gi\|5732378\|AF156455\| | Influenza A virus (A/Shorebird/Delaware/9/96(H9N2)) segment 3 polymerase (PA) gene, partial cds. |
| gi\|5732380\|AF156456\| | Influenza A virus (A/Quail/Arkansas/29209-1/93(H9N2)) segment 3 polymerase (PA) gene, partial cds. |
| gi\|5732382\|AF156457\| | Influenza A virus (A/Turkey/California/189/66(H9N2)) segment 3 polymerase (PA) gene, partial cds. |
| gi\|12060671\|AF222642\| | Influenza A virus (A/Quail/Hong Kong/A17/99(H9N2)) segment 3 PA (PA) gene, partial cds. |
| gi\|12060673\|AF222643\| | Influenza A virus (A/Pigeon/Hong Kong/FY6/99(H9N2)) segment 3 PA (PA) gene, partial cds. |
| gi\|12060675\|AF222644\| | Influenza A virus (A/Chicken/Hong Kong/NT16/99(H9N2)) segment 3 PA (PA) gene, partial cds. |

TABLE 6-continued

| | |
|---|---|
| gi\|12060677\|AF222645\| | Influenza A virus (A/Quail/Hong Kong/SSP10/99(H9N2)) segment 3 PA (PA) gene, partial cds. |
| gi\|12060679\|AF222646\| | Influenza A virus (A/Pheasant/Hong Kong/SSP11/99(H9N2)) segment 3 PA (PA) gene, partial cds. |
| gi\|12060681\|AF222647\| | Influenza A virus (A/Chicken/Hong Kong/FY20/99(H9N2)) segment 3 PA (PA) gene, partial cds. |
| gi\|12060683\|AF222648\| | Influenza A virus (A/Chicken/Hong Kong/KC12/99(H9N2)) segment 3 PA (PA) gene, partial cds. |
| gi\|12060685\|AF222649\| | Influenza A virus (A/Quail/Hong Kong/NT28/99(H9N2)) segment 3 PA (PA) gene, partial cds. |
| gi\|12060687\|AF222650\| | Influenza A virus (A/Chicken/Hong Kong/SF2/99(H9N2)) segment 3 PA (PA) gene, partial cds. |
| gi\|12060689\|AF222651\| | Influenza A virus (A/Silky Chicken/Hong Kong/SF44/99(H9N2)) segment 3 PA (PA) gene, partial cds. |

SEQUENCE LISTING (1457 sequences)

SEQ ID NO: 1 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uggaagcaauggcuuuccutn

SEQ ID NO: 2 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aggaaagccauugcuuccatn

SEQ ID NO: 3 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggcaccaaacgaucuuaugtn

SEQ ID NO: 4 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cauaagaucguuuggugcctn

SEQ ID NO: 5 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aggcaccaaacgaucuuautn

SEQ ID NO: 6 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auaagaucguuuggugccutn

SEQ ID NO: 7 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcaccaaacgaucuuaugatn

SEQ ID NO: 8 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucauaagaucguuuggugctn

SEQ ID NO: 9 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuucuaaccgaggucgaaatn

SEQ ID NO: 10 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuucgaccucgguuagaagtn

SEQ ID NO: 11 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gucgaaacguacguucucutn

SEQ ID NO: 12 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agagaacguacguuucgactn

SEQ ID NO: 13 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cucaaagccgagaucgcgctn

SEQ ID NO: 14 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcgcgaucucggcuuugagtn

SEQ ID NO: 15 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uucuaaccgaggucgaaactn

SEQ ID NO: 16 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guuucgaccucgguuagaatn

SEQ ID NO: 17 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuaaccgaggucgaaacgtn

SEQ ID NO: 18 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cguuucgaccucgguuagatn

SEQ ID NO: 19 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucgaaacguacguucucuctn

SEQ ID NO: 20 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gagagaacguacguuucgatn

SEQ ID NO: 21 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgaaacguacguucucucutn

SEQ ID NO: 22 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agagagaacguacguuucgtn

SEQ ID NO: 23 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaacguacguucucucuautn

SEQ ID NO: 24 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auagagagaacguacguuutn

SEQ ID NO: 25 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cccccucaaagccgagauctn

SEQ ID NO: 26 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaucucggcuuugagggggtn

SEQ ID NO: 27 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cccucaaagccgagaucgctn

SEQ ID NO: 28 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcgaucucggcuuugagggtn

SEQ ID NO: 29 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccucaaagccgagaucgcgtn

SEQ ID NO: 30 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgcgaucucggcuuugaggtn

SEQ ID NO: 31 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acaagaccaauccugucactn

SEQ ID NO: 32 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gugacaggauuggucuugutn

SEQ ID NO: 33 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agcgaggacugcagcguagtn

SEQ ID NO: 34 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuacgcugcaguccucgcutn

SEQ ID NO: 35 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgaggacugcagcguagactn

SEQ ID NO: 36 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gucuacgcugcaguccucgtn

SEQ ID NO: 37 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugcacuugauauuguggatn

SEQ ID NO: 38 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uccacaauaucaagugcaatn

SEQ ID NO: 39 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugcacuugauauuguggautn

SEQ ID NO: 40 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auccacaauaucaagugcatn

SEQ ID NO: 41 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auacgguuugaaaagagggtn

SEQ ID NO: 42 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cccucuuuucaaaccguautn

SEQ ID NO: 43 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uacgguuugaaaagagggctn

SEQ ID NO: 44 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcccucuuuucaaaccguatn

SEQ ID NO: 45 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acgguuugaaaagagggcctn

SEQ ID NO: 46 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggcccucuuuucaaaccgutn

SEQ ID NO: 47 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgguuugaaaagagggccutn

SEQ ID NO: 48 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aggcccucuuuucaaaccgtn

SEQ ID NO: 49 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuaaccgaggucgaaacgutn

SEQ ID NO: 50 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acguuucgaccucgguuagtn

SEQ ID NO: 51 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uaaccgaggucgaaacguatn

SEQ ID NO: 52 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uacguuucgaccucgguuatn

SEQ ID NO: 53 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaccgaggucgaaacguactn

SEQ ID NO: 54 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guacguuucgaccucgguutn

SEQ ID NO: 55 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
accgaggucgaaacguacgtn

SEQ ID NO: 56 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cguacguuucgaccucggutn

SEQ ID NO: 57 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccgaggucgaaacguacgutn

SEQ ID NO: 58 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acguacguuucgaccucggtn

SEQ ID NO: 59 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgaggucgaaacguacguutn

SEQ ID NO: 60 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aacguacguuucgaccucgtn

SEQ ID NO: 61 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaggucgaaacguacguuctn

SEQ ID NO: 62 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaacguacguuucgaccuctn

SEQ ID NO: 63 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aggucgaaacguacguucutn

SEQ ID NO: 64 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agaacguacguuucgaccutn

SEQ ID NO: 65 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggucgaaacguacguucuctn

SEQ ID NO: 66 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gagaacguacguuucgacctn

SEQ ID NO: 67 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcuaaagacaagaccaauctn

SEQ ID NO: 68 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gauuggucuugucuuuagctn

SEQ ID NO: 69 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aauccugucaccucugacutn

SEQ ID NO: 70 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agucagaggugacaggauutn

SEQ ID NO: 71 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uccugucaccucugacuaatn

SEQ ID NO: 72 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuagucagaggugacaggatn

SEQ ID NO: 73 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cacgcucaccgugcccagutn

SEQ ID NO: 74 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acugggcacggugagcgugtn

SEQ ID NO: 75 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acgcucaccgugcccagugtn

SEQ ID NO: 76 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cacugggcacggugagcgutn

SEQ ID NO: 77 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgcucaccgugcccagugatn

SEQ ID NO: 78 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucacugggcacggugagcgtn

SEQ ID NO: 79 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcucaccgugcccagugagtn

SEQ ID NO: 80 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cucacugggcacggugagctn

SEQ ID NO: 81 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caccgugcccagugagcgatn

SEQ ID NO: 82 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucgcucacugggcacggugtn

SEQ ID NO: 83 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gagcgaggacugcagcguatn

SEQ ID NO: 84 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uacgcugcaguccucgcuctn

SEQ ID NO: 85 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uauuguggauucuugaucgtn

SEQ ID NO: 86 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgaucaagaauccacaauatn

SEQ ID NO: 87 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuguggauucuugaucguctn

SEQ ID NO: 88 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gacgaucaagaauccacaatn

SEQ ID NO: 89 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uguggauucuugaucgucutn

SEQ ID NO: 90 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agacgaucaagaauccacatn

SEQ ID NO: 91 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guggauucuugaucgucuutn

SEQ ID NO: 92 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aagacgaucaagaauccactn

SEQ ID NO: 93 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucaaaugcauuuaucgucgtn

SEQ ID NO: 94 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgacgauaaaugcauuugatn

SEQ ID NO: 95 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caaaugcauuuaucgucgctn

SEQ ID NO: 96 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcgacgauaaaugcauuugtn

SEQ ID NO: 97 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methyluridine-5'-phosphate
  modified_base (7)..(7): 2'-O-methylcytidine-5'-phosphate
  modified_base (10)..(10): 2'-O-methyluridine-5'-phosphate
  modified_base (13)..(13): 2'-O-methylcytidine-5'-phosphate
  modified_base (14)..(16): 2'-O-methyluridine-5'-phosphate
  modified_base (17)..(18): 2'-O-methylcytidine-5'-phosphate
  modified_base (19)..(19): 2'-O-methyluridine-5'-phosphate
  modified_base (21)..(21): thymidine 5'-phosphorothioate
uggaagcaauggcuuuccutn

SEQ ID NO: 98 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): 2'-O-methylcytidine-5'-phosphate
  modified_base (18)..(18): 2'-O-methylcytidine-5'-phosphate
  modified_base (21)..(21): thymidine 5'-phosphorothioate
aggaaagccauugcuuccatn

SEQ ID NO: 99 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): 2'-O-methylcytidine-5'-phosphate
  modified_base (5)..(6): 2'-O-methylcytidine-5'-phosphate
  modified_base (10)..(10): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (15)..(16): 2'-O-methyluridine-5'-phosphate
  modified_base (18)..(18): 2'-O-methyluridine-5'-phosphate
  modified_base (21)..(21): thymidine 5'-phosphorothioate
ggcaccaaacgaucuuaugtn

SEQ ID NO: 100 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methylcytidine-5'-phosphate
  modified_base (3)..(3): 2'-O-methyluridine-5'-phosphate
  modified_base (21)..(21): thymidine 5'-phosphorothioate
cauaagaucguuuggugcctn

SEQ ID NO: 101 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): 2'-O-methylcytidine-5'-phosphate
  modified_base (6)..(7): 2'-O-methylcytidine-5'-phosphate
  modified_base (11)..(11): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (16)..(17): 2'-O-methyluridine-5'-phosphate
  modified_base (19)..(19): 2'-O-methyluridine-5'-phosphate
  modified_base (21)..(21): thymidine 5'-phosphorothioate
aggcaccaaacgaucuuautn

SEQ ID NO: 102 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methyluridine-5'-phosphate
  modified_base (21)..(21): thymidine 5'-phosphorothioate
auaagaucguuuggugccutn

SEQ ID NO: 103 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methylcytidine-5'-phosphate
  modified_base (4)..(5): 2'-O-methylcytidine-5'-phosphate
  modified_base (9)..(9): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (14)..(15): 2'-O-methyluridine-5'-phosphate
  modified_base (17)..(17): 2'-O-methyluridine-5'-phosphate
  modified_base (21)..(21): thymidine 5'-phosphorothioate
gcaccaaacgaucuuaugatn

SEQ ID NO: 104 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methylcytidine-5'-phosphate
  modified_base (4)..(4): 2'-O-methyluridine-5'-phosphate
  modified_base (21)..(21): thymidine 5'-phosphorothioate
ucauaagaucguuuggugctn

SEQ ID NO: 105 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methylcytidine-5'-phosphate
  modified_base (2)..(3): 2'-O-methyluridine-5'-phosphate
  modified_base (4)..(4): 2'-O-methylcytidine-5'-phosphate
  modified_base (5)..(5): 2'-O-methyluridine-5'-phosphate
  modified_base (8)..(9): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (21)..(21): thymidine 5'-phosphorothioate
cuucuaaccgaggucgaaatn

SEQ ID NO: 106 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): 2'-O-methyluridine-5'-phosphate
  modified_base (21)..(21): thymidine 5'-phosphorothioate
uuucgaccucgguuagaagtn

SEQ ID NO: 107 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methyluridine-5'-phosphate
  modified_base (3)..(3): 2'-O-methylcytidine-5'-phosphate
  modified_base (8)..(8): 2'-O-methylcytidine-5'-phosphate
  modified_base (10)..(10): 2'-O-methyluridine-5'-phosphate
  modified_base (12)..(12): 2'-O-methylcytidine-5'-phosphate
  modified_base (14)..(15): 2'-O-methyluridine-5'-phosphate
  modified_base (16)..(16): 2'-O-methylcytidine-5'-phosphate
  modified_base (17)..(17): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): thymidine 5'-phosphorothioate
gucgaaacguacguucucutn

SEQ ID NO: 108 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): 2'-O-methyluridine-5'-phosphate
  modified_base (21)..(21): thymidine 5'-phosphorothioate
agagaacguacguuucgactn

SEQ ID NO: 109 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methylcytidine-5'-phosphate
  modified_base (2)..(2): 2'-O-methyluridine-5'-phosphate
  modified_base (3)..(3): 2'-O-methylcytidine-5'-phosphate
  modified_base (8)..(9): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (17)..(17): 2'-O-methylcytidine-5'-phosphate
  modified_base (19)..(19): 2'-O-methylcytidine-5'-phosphate
  modified_base (21)..(21): thymidine 5'-phosphorothioate
cucaaagccgagaucgcgctn

SEQ ID NO: 110 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): 2'-O-methyluridine-5'-phosphate
  modified_base (21)..(21): thymidine 5'-phosphorothioate
gcgcgaucucggcuuugagtn

SEQ ID NO: 111 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(2): 2'-O-methyluridine-5'-phosphate
  modified_base (3)..(3): 2'-O-methylcytidine-5'-phosphate
  modified_base (4)..(4): 2'-O-methyluridine-5'-phosphate
  modified_base (7)..(8): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (19)..(19): 2'-O-methylcytidine-5'-phosphate
  modified_base (21)..(21): thymidine 5'-phosphorothioate
uucuaaccgaggucgaaactn

SEQ ID NO: 112 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): 2'-O-methyluridine-5'-phosphate
  modified_base (21)..(21): thymidine 5'-phosphorothioate
guuucgaccucgguuagaatn

SEQ ID NO: 113 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methyluridine-5'-phosphate
  modified_base (2)..(2): 2'-O-methylcytidine-5'-phosphate
  modified_base (3)..(3): 2'-O-methyluridine-5'-phosphate
  modified_base (6)..(7): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (18)..(18): 2'-O-methylcytidine-5'-phosphate
  modified_base (21)..(21): thymidine 5'-phosphorothioate
ucuaaccgaggucgaaacgtn

SEQ ID NO: 114 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): 2'-O-methyluridine-5'-phosphate
  modified_base (21)..(21): thymidine 5'-phosphorothioate
cguuucgaccucgguuagatn

SEQ ID NO: 115 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methyluridine-5'-phosphate
  modified_base (2)..(2): 2'-O-methylcytidine-5'-phosphate
  modified_base (7)..(7): 2'-O-methylcytidine-5'-phosphate
  modified_base (9)..(9): 2'-O-methyluridine-5'-phosphate
  modified_base (11)..(11): 2'-O-methylcytidine-5'-phosphate
  modified_base (13)..(14): 2'-O-methyluridine-5'-phosphate
  modified_base (15)..(15): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): thymidine 5'-phosphorothioate
ucgaaacguacguucucuctn

SEQ ID NO: 116 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): 2'-O-methyluridine-5'-phosphate
  modified_base (21)..(21): thymidine 5'-phosphorothioate
gagagaacguacguuucgatn

SEQ ID NO: 117 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methylcytidine-5'-phosphate
  modified_base (6)..(6): 2'-O-methylcytidine-5'-phosphate
  modified_base (8)..(8): 2'-O-methyluridine-5'-phosphate
  modified_base (10)..(10): 2'-O-methylcytidine-5'-phosphate
  modified_base (12)..(13): 2'-O-methyluridine-5'-phosphate
  modified_base (14)..(14): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (17)..(17): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): thymidine 5'-phosphorothioate
cgaaacguacguucucucutn

SEQ ID NO: 118 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): 2'-O-methyluridine-5'-phosphate
  modified_base (21)..(21): thymidine 5'-phosphorothioate
agagagaacguacguuucgtn

SEQ ID NO: 119 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): 2'-O-methylcytidine-5'-phosphate
  modified_base (6)..(6): 2'-O-methyluridine-5'-phosphate
  modified_base (8)..(8): 2'-O-methylcytidine-5'-phosphate
  modified_base (10)..(11): 2'-O-methyluridine-5'-phosphate
  modified_base (12)..(12): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (17)..(17): 2'-O-methyluridine-5'-phosphate
  modified_base (19)..(19): 2'-O-methyluridine-5'-phosphate
  modified_base (21)..(21): thymidine 5'-phosphorothioate
aaacguacguucucucuautn

SEQ ID NO: 120 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methyluridine-5'-phosphate
  modified_base (13)..(13): 2'-O-methyluridine-5'-phosphate
  modified_base (21)..(21): thymidine 5'-phosphorothioate
auagagagaacguacguuutn

SEQ ID NO: 121 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(3): 2'-O-methylcytidine-5'-phosphate
  modified_base (4)..(4): 2'-O-methyluridine-5'-phosphate
  modified_base (5)..(5): 2'-O-methylcytidine-5'-phosphate
  modified_base (10)..(11): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (19)..(19): 2'-O-methylcytidine-5'-phosphate
  modified_base (21)..(21): thymidine 5'-phosphorothioate
cccucaaagccgagaucgctn

SEQ ID NO: 122 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): 2'-O-methyluridine-5'-phosphate
  modified_base (21)..(21): thymidine 5'-phosphorothioate
gcgaucucggcuuugagggtn

SEQ ID NO: 123 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(2): 2'-O-methylcytidine-5'-phosphate
  modified_base (3)..(3): 2'-O-methyluridine-5'-phosphate
  modified_base (4)..(4): 2'-O-methylcytidine-5'-phosphate
  modified_base (9)..(10): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (18)..(18): 2'-O-methylcytidine-5'-phosphate
  modified_base (21)..(21): thymidine 5'-phosphorothioate
ccucaaagccgagaucgcgtn

SEQ ID NO: 124 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): 2'-O-methyluridine-5'-phosphate
  modified_base (21)..(21): thymidine 5'-phosphorothioate
cgcgaucucggcuuugaggtn

SEQ ID NO: 125 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methylcytidine-5'-phosphate
  modified_base (7)..(8): 2'-O-methylcytidine-5'-phosphate
  modified_base (11)..(11): 2'-O-methyluridine-5'-phosphate
  modified_base (12)..(13): 2'-O-methylcytidine-5'-phosphate
  modified_base (14)..(14): 2'-O-methyluridine-5'-phosphate
  modified_base (16)..(16): 2'-O-methyluridine-5'-phosphate
  modified_base (17)..(17): 2'-O-methylcytidine-5'-phosphate
  modified_base (19)..(19): 2'-O-methylcytidine-5'-phosphate
  modified_base (21)..(21): thymidine 5'-phosphorothioate
acaagaccaauccugucactn

SEQ ID NO: 126 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): 2'-O-methylcytidine-5'-phosphate
  modified_base (21)..(21): thymidine 5'-phosphorothioate
gugacaggauuggucuugutn

SEQ ID NO: 127 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): 2'-O-methylcytidine-5'-phosphate
  modified_base (9)..(9): 2'-O-methylcytidine-5'-phosphate
  modified_base (10)..(10): 2'-O-methyluridine-5'-phosphate
  modified_base (12)..(12): 2'-O-methylcytidine-5'-phosphate
  modified_base (15)..(15): 2'-O-methylcytidine-5'-phosphate
  modified_base (17)..(17): 2'-O-methyluridine-5'-phosphate
  modified_base (21)..(21): thymidine 5'-phosphorothioate
agcgaggacugcagcguagtn

SEQ ID NO: 128 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methyluridine-5'-phosphate
  modified_base (9)..(9): 2'-O-methylcytidine-5'-phosphate
  modified_base (21)..(21): thymidine 5'-phosphorothioate
cuacgcugcaguccucgcutn

SEQ ID NO: 129 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methylcytidine-5'-phosphate
  modified_base (7)..(7): 2'-O-methylcytidine-5'-phosphate
  modified_base (8)..(8): 2'-O-methyluridine-5'-phosphate
  modified_base (10)..(10): 2'-O-methylcytidine-5'-phosphate
  modified_base (13)..(13): 2'-O-methylcytidine-5'-phosphate
  modified_base (15)..(15): 2'-O-methyluridine-5'-phosphate
  modified_base (19)..(19): 2'-O-methylcytidine-5'-phosphate
  modified_base (21)..(21): thymidine 5'-phosphorothioate
cgaggacugcagcguagactn

SEQ ID NO: 130 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): 2'-O-methyluridine-5'-phosphate
  modified_base (11)..(11): 2'-O-methylcytidine-5'-phosphate
  modified_base (21)..(21): thymidine 5'-phosphorothioate
gucuacgcugcaguccucgtn

SEQ ID NO: 131 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(2): 2'-O-methyluridine-5'-phosphate
  modified_base (4)..(4): 2'-O-methylcytidine-5'-phosphate
  modified_base (6)..(6): 2'-O-methylcytidine-5'-phosphate
  modified_base (7)..(8): 2'-O-methyluridine-5'-phosphate
  modified_base (11)..(11): 2'-O-methyluridine-5'-phosphate
  modified_base (13)..(14): 2'-O-methyluridine-5'-phosphate
  modified_base (16)..(16): 2'-O-methyluridine-5'-phosphate
  modified_base (21)..(21): thymidine 5'-phosphorothioate
uugcacuugauauuguggatn

SEQ ID NO: 132 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): 2'-O-methylcytidine-5'-phosphate
  modified_base (5)..(5): 2'-O-methylcytidine-5'-phosphate
  modified_base (8)..(8): 2'-O-methyluridine-5'-phosphate
  modified_base (11)..(11): 2'-O-methylcytidine-5'-phosphate
  modified_base (17)..(17): 2'-O-methylcytidine-5'-phosphate
  modified_base (21)..(21): thymidine 5'-phosphorothioate
uccacaauaucaagugcaatn

SEQ ID NO: 133 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methyluridine-5'-phosphate
  modified_base (3)..(3): 2'-O-methylcytidine-5'-phosphate
  modified_base (5)..(5): 2'-O-methylcytidine-5'-phosphate
  modified_base (6)..(7): 2'-O-methyluridine-5'-phosphate
  modified_base (10)..(10): 2'-O-methyluridine-5'-phosphate
  modified_base (12)..(13): 2'-O-methyluridine-5'-phosphate
  modified_base (15)..(15): 2'-O-methyluridine-5'-phosphate
  modified_base (19)..(19): 2'-O-methyluridine-5'-phosphate
  modified_base (21)..(21): thymidine 5'-phosphorothioate
ugcacuugauauuguggautn

SEQ ID NO: 134 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): 2'-O-methylcytidine-5'-phosphate
  modified_base (6)..(6): 2'-O-methylcytidine-5'-phosphate
  modified_base (9)..(9): 2'-O-methyluridine-5'-phosphate
  modified_base (12)..(12): 2'-O-methylcytidine-5'-phosphate
  modified_base (18)..(18): 2'-O-methylcytidine-5'-phosphate
  modified_base (21)..(21): thymidine 5'-phosphorothioate
auccacaauaucaagugcatn

SEQ ID NO: 135 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methylcytidine-5'-phosphate
  modified_base (2)..(2): 2'-O-methyluridine-5'-phosphate
  modified_base (5)..(6): 2'-O-methylcytidine-5'-phosphate
  modified_base (11)..(11): 2'-O-methyluridine-5'-phosphate
  modified_base (12)..(12): 2'-O-methylcytidine-5'-phosphate
  modified_base (17)..(17): 2'-O-methylcytidine-5'-phosphate
  modified_base (19)..(19): 2'-O-methyluridine-5'-phosphate
  modified_base (21)..(21): thymidine 5'-phosphorothioate
cuaaccgaggucgaaacgutn

SEQ ID NO: 136 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): 2'-O-methyluridine-5'-phosphate
  modified_base (21)..(21): thymidine 5'-phosphorothioate
acguuucgaccucgguuagtn

SEQ ID NO: 137 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methyluridine-5'-phosphate
  modified_base (4)..(5): 2'-O-methylcytidine-5'-phosphate
  modified_base (10)..(10): 2'-O-methyluridine-5'-phosphate
  modified_base (11)..(11): 2'-O-methylcytidine-5'-phosphate
  modified_base (16)..(16): 2'-O-methylcytidine-5'-phosphate
  modified_base (18)..(18): 2'-O-methyluridine-5'-phosphate
  modified_base (21)..(21): thymidine 5'-phosphorothioate
uaaccgaggucgaaacguatn

SEQ ID NO: 138 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methyluridine-5'-phosphate
  modified_base (18)..(18): 2'-O-methyluridine-5'-phosphate
  modified_base (21)..(21): thymidine 5'-phosphorothioate
uacguuucgaccucgguuatn

SEQ ID NO: 139 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(4): 2'-O-methylcytidine-5'-phosphate
  modified_base (9)..(9): 2'-O-methyluridine-5'-phosphate
  modified_base (10)..(10): 2'-O-methylcytidine-5'-phosphate
  modified_base (15)..(15): 2'-O-methylcytidine-5'-phosphate
  modified_base (17)..(17): 2'-O-methyluridine-5'-phosphate
  modified_base (19)..(19): 2'-O-methylcytidine-5'-phosphate
  modified_base (21)..(21): thymidine 5'-phosphorothioate
aaccgaggucgaaacguactn

SEQ ID NO: 140 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methyluridine-5'-phosphate
  modified_base (21)..(21): thymidine 5'-phosphorothioate
guacguuucgaccucgguutn

SEQ ID NO: 141 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(3): 2'-O-methylcytidine-5'-phosphate
  modified_base (8)..(8): 2'-O-methyluridine-5'-phosphate
  modified_base (9)..(9): 2'-O-methylcytidine-5'-phosphate
  modified_base (14)..(14): 2'-O-methylcytidine-5'-phosphate
  modified_base (16)..(16): 2'-O-methyluridine-5'-phosphate
  modified_base (18)..(18): 2'-O-methylcytidine-5'-phosphate
  modified_base (21)..(21): thymidine 5'-phosphorothioate
accgaggucgaaacguacgtn

SEQ ID NO: 142 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): 2'-O-methyluridine-5'-phosphate
  modified_base (21)..(21): thymidine 5'-phosphorothioate
cguacguuucgaccucggutn

SEQ ID NO: 143 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(2): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (13)..(13): 2'-O-methylcytidine-5'-phosphate
  modified_base (15)..(15): 2'-O-methyluridine-5'-phosphate
  modified_base (17)..(17): 2'-O-methylcytidine-5'-phosphate
  modified_base (19)..(19): 2'-O-methyluridine-5'-phosphate
  modified_base (21)..(21): thymidine 5'-phosphorothioate
ccgaggucgaaacguacgutn

SEQ ID NO: 144 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): 2'-O-methyluridine-5'-phosphate
  modified_base (21)..(21): thymidine 5'-phosphorothioate
acguacguuucgaccucggtn

SEQ ID NO: 145 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
augagucuucuaaccgaggtn

SEQ ID NO: 146 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccucgguuagaagacucautn

SEQ ID NO: 147 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuucuaaccgaggucgaatn

SEQ ID NO: 148 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uucgaccucgguuagaagatn

SEQ ID NO: 149 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gucuucuaaccgaggucgatn

SEQ ID NO: 150 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucgaccucgguuagaagactn

SEQ ID NO: 151 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuucagaucgaacggucuatn

SEQ ID NO: 152 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uagaccguucgaucugaagtn

SEQ ID NO: 153 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cagaucgaacggucuaacatn

SEQ ID NO: 154 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uguuagaccguucgaucugtn

SEQ ID NO: 155 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agaucgaacggucuaacagtn

SEQ ID NO: 156 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuguuagaccguucgaucutn

SEQ ID NO: 157 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caaaaugcuauaaguaccatn

SEQ ID NO: 158 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugguacuuauagcauuuugtn

SEQ ID NO: 159 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uucagaucgaacggucuaatn

SEQ ID NO: 160 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuagaccguucgaucugaatn

SEQ ID NO: 161 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uaccacauucccuuauacutn

SEQ ID NO: 162 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aguauaagggaaugugguatn

SEQ ID NO: 163 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuuacauaaaucggacagtn

SEQ ID NO: 164 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuguccgauuuauguaagatn

SEQ ID NO: 165 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gucuuacauaaaucggacatn

SEQ ID NO: 166 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uguccgauuuauguaagactn

SEQ ID NO: 167 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agucuuacauaaaucggactn

SEQ ID NO: 168 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guccgauuuauguaagacutn

SEQ ID NO: 169 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccucugaugauuucgcucutn

SEQ ID NO: 170 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agagcgaaaucaucagaggtn

SEQ ID NO: 171 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggaugucaauccgacuuuatn

SEQ ID NO: 172 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uaaagucggauugacaucctn

SEQ ID NO: 173 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuugagagagaaggguacutn

SEQ ID NO: 174 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aguacccuucucucucaaatn

SEQ ID NO: 175 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aggcaacgaacccgaucgutn

SEQ ID NO: 176 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acgaucggguucguugccutn

SEQ ID NO: 177 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggcaacgaacccgaucgugtn

SEQ ID NO: 178 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cacgaucggguucguugcctn

SEQ ID NO: 179 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caacgaacccgaucgugcctn

SEQ ID NO: 180 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggcacgaucggguucguugtn

SEQ ID NO: 181 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcaacgaacccgaucgugctn

SEQ ID NO: 182 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcacgaucggguucguugctn

SEQ ID NO: 183 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaaaaggcaacgaacccgatn

SEQ ID NO: 184 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucggguucguugccuuuuctn

SEQ ID NO: 185 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucgagcucucggacgaaaatn

SEQ ID NO: 186 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuuucguccgagagcucgatn

SEQ ID NO: 187 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aacgaacccgaucgugccutn

SEQ ID NO: 188 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aggcacgaucggguucguutn

SEQ ID NO: 189 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uauuucuucggagacaaugtn

SEQ ID NO: 190 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cauugucuccgaagaaauatn

SEQ ID NO: 191 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugcaugauaaaggcagucctn

SEQ ID NO: 192 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggacugccuuuaucaugcatn

SEQ ID NO: 193 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auggggaugaucggaauautn

SEQ ID NO: 194 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auauuccgaucauccccautn

SEQ ID NO: 195 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uggggaugaucggaauauutn

SEQ ID NO: 196 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aauauuccgaucauccccatn

SEQ ID NO: 197 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaaacgggacucuagcauatn

SEQ ID NO: 198 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uaugcuagagucccguuuctn

SEQ ID NO: 199 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agacuuugugcgacaaugctn

SEQ ID NO: 200 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcauugucgcacaaagucutn

SEQ ID NO: 201 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gacuuugugcgacaaugcutn

SEQ ID NO: 202 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agcauugucgcacaaaguctn

SEQ ID NO: 203 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuaugggauuccuuucgutn

SEQ ID NO: 204 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acgaaaggaaucccauagatn

SEQ ID NO: 205 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuaugggauuccuuucguctn

SEQ ID NO: 206 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gacgaaaggaaucccauagtn

SEQ ID NO: 207 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auguggauggauucgaacctn

SEQ ID NO: 208 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gguucgaauccauccacautn

SEQ ID NO: 209 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uguggauggauucgaaccgtn

SEQ ID NO: 210 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgguucgaauccauccacatn

SEQ ID NO: 211 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guggauggauucgaaccgatn

SEQ ID NO: 212 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucgguucgaauccauccactn

SEQ ID NO: 213 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uggauggauucgaaccgaatn

SEQ ID NO: 214 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uucgguucgaauccauccatn

SEQ ID NO: 215 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggauggauucgaaccgaactn

SEQ ID NO: 216 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guucgguucgaauccaucctn

SEQ ID NO: 217 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gauggauucgaaccgaacgtn

SEQ ID NO: 218 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cguucgguucgaauccauctn

SEQ ID NO: 219 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auggauucgaaccgaacggtn

SEQ ID NO: 220 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccguucgguucgaauccautn

SEQ ID NO: 221 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uggauucgaaccgaacggctn

SEQ ID NO: 222 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gccguucgguucgaauccatn

SEQ ID NO: 223 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aucuccacaacucgaggggtn

SEQ ID NO: 224 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccccucgaguuguggagautn

SEQ ID NO: 225 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uaacaauagagagaauggutn

SEQ ID NO: 226 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
accauucucucuauuguuatn

SEQ ID NO: 227 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaaacguacguucucucuatn

SEQ ID NO: 228 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uagagagaacguacguuuctn

SEQ ID NO: 229 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aacguacguucucucuauctn

SEQ ID NO: 230 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gauagagagaacguacguutn

SEQ ID NO: 231 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uggcuaaagacaagaccaatn

SEQ ID NO: 232 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuggucuugucuuuagccatn

SEQ ID NO: 233 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggcuaaagacaagaccaautn

SEQ ID NO: 234 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auuggucuugucuuuagcctn

SEQ ID NO: 235 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuaaagacaagaccaaucctn

SEQ ID NO: 236 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggauuggucuugucuuuagtn

SEQ ID NO: 237 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uaaagacaagaccaauccutn

SEQ ID NO: 238 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aggauuggucuugucuuuatn

SEQ ID NO: 239 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaagacaagaccaauccugtn

SEQ ID NO: 240 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caggauuggucuugucuuutn

SEQ ID NO: 241 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aagacaagaccaauccugutn

SEQ ID NO: 242 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acaggauuggucuugucuutn

SEQ ID NO: 243 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agacaagaccaauccuguctn

SEQ ID NO: 244 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gacaggauuggucuugucutn

SEQ ID NO: 245 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gacaagaccaauccugucatn

SEQ ID NO: 246 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugacaggauuggucuuguctn

SEQ ID NO: 247 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caagaccaauccugucacctn

SEQ ID NO: 248 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggugacaggauuggucuugtn

SEQ ID NO: 249 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aagaccaauccugucaccutn

SEQ ID NO: 250 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aggugacaggauuggucuutn

SEQ ID NO: 251 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agaccaauccugucaccuctn

SEQ ID NO: 252 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaggugacaggauuggucutn

SEQ ID NO: 253 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaccaauccugucaccucutn

SEQ ID NO: 254 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agaggugacaggauugguctn

SEQ ID NO: 255 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
accaauccugucaccucugtn

SEQ ID NO: 256 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cagaggugacaggauuggutn

SEQ ID NO: 257 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccaauccugucaccucugatn

SEQ ID NO: 258 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucagaggugacaggauuggtn

SEQ ID NO: 259 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caauccugucaccucugactn

SEQ ID NO: 260 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gucagaggugacaggauugtn

SEQ ID NO: 261 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auccugucaccucugacuatn

SEQ ID NO: 262 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uagucagaggugacaggautn

SEQ ID NO: 263 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uucacgcucaccgugcccatn

SEQ ID NO: 264 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugggcacggugagcgugaatn

SEQ ID NO: 265 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucacgcucaccgugcccagtn

SEQ ID NO: 266 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cugggcacggugagcgugatn

SEQ ID NO: 267 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cucaccgugcccagugagctn

SEQ ID NO: 268 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcucacugggcacggugagtn

SEQ ID NO: 269 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucaccgugcccagugagcgtn

SEQ ID NO: 270 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgcucacugggcacggugatn

SEQ ID NO: 271 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
accgugcccagugagcgagtn

SEQ ID NO: 272 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cucgcucacugggcacggutn

SEQ ID NO: 273 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccgugcccagugagcgaggtn

SEQ ID NO: 274 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccucgcucacugggcacggtn

SEQ ID NO: 275 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgugcccagugagcgaggatn

SEQ ID NO: 276 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uccucgcucacugggcacgtn

SEQ ID NO: 277 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gugcccagugagcgaggactn

SEQ ID NO: 278 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guccucgcucacugggcactn

SEQ ID NO: 279 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugcccagugagcgaggacutn

SEQ ID NO: 280 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aguccucgcucacugggcatn

SEQ ID NO: 281 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcccagugagcgaggacugtn

SEQ ID NO: 282 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caguccucgcucacugggctn

SEQ ID NO: 283 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cccagugagcgaggacugctn

SEQ ID NO: 284 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcaguccucgcucacugggtn

SEQ ID NO: 285 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccagugagcgaggacugcatn

SEQ ID NO: 286 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugcaguccucgcucacuggtn

SEQ ID NO: 287 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cagugagcgaggacugcagtn

SEQ ID NO: 288 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cugcaguccucgcucacugtn

SEQ ID NO: 289 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agugagcgaggacugcagctn

SEQ ID NO: 290 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcugcaguccucgcucacutn

SEQ ID NO: 291 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gugagcgaggacugcagcgtn

SEQ ID NO: 292 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgcugcaguccucgcucactn

SEQ ID NO: 293 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugagcgaggacugcagcgutn

SEQ ID NO: 294 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acgcugcaguccucgcucatn

SEQ ID NO: 295 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcgaggacugcagcguagatn

SEQ ID NO: 296 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuacgcugcaguccucgctn

SEQ ID NO: 297 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaggacugcagcguagacgtn

SEQ ID NO: 298 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgucuacgcugcaguccuctn

SEQ ID NO: 299 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcacuugauauuguggauutn

SEQ ID NO: 300 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aauccacaauaucaagugctn

SEQ ID NO: 301 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cacuugauauuguggauuctn

SEQ ID NO: 302 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaauccacaauaucaagugtn

SEQ ID NO: 303 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acuugauauuguggauucutn

SEQ ID NO: 304 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agaauccacaauaucaagutn

SEQ ID NO: 305 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuugauauuguggauucuutn

SEQ ID NO: 306 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aagaauccacaauaucaagtn

SEQ ID NO: 307 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugauauuguggauucuugtn

SEQ ID NO: 308 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caagaauccacaauaucaatn

SEQ ID NO: 309 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugauauuguggauucuugatn

SEQ ID NO: 310 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucaagaauccacaauaucatn

SEQ ID NO: 311 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gauauuguggauucuugautn

SEQ ID NO: 312 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aucaagaauccacaauauctn

SEQ ID NO: 313 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auauuguggauucuugauctn

SEQ ID NO: 314 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaucaagaauccacaauautn

SEQ ID NO: 315 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggauucuugaucgucuuuutn

SEQ ID NO: 316 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaaagacgaucaagaaucctn

SEQ ID NO: 317 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccgucaggcccccucaaagtn

SEQ ID NO: 318 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuuugagggggccugacggtn

SEQ ID NO: 319 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgucaggcccccucaaagctn

SEQ ID NO: 320 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcuuugagggggccugacgtn

SEQ ID NO: 321 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gucaggcccccucaaagcctn

SEQ ID NO: 322 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggcuuugagggggccugactn

SEQ ID NO: 323 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucaggcccccucaaagccgtn

SEQ ID NO: 324 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cggcuuugagggggccugatn

SEQ ID NO: 325 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caggcccccucaaagccgatn

SEQ ID NO: 326 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucggcuuugagggggccugtn

SEQ ID NO: 327 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aggcccccucaaagccgagtn

SEQ ID NO: 328 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cucggcuuugagggggccutn

SEQ ID NO: 329 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggcccccucaaagccgagatn

SEQ ID NO: 330 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucucggcuuugagggggcctn

SEQ ID NO: 331 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcccccucaaagccgagautn

SEQ ID NO: 332 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aucucggcuuugagggggctn

SEQ ID NO: 333 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccccucaaagccgagaucgtn

SEQ ID NO: 334 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgaucucggcuuugaggggtn

SEQ ID NO: 335 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgagagaggcgaagagacatn

SEQ ID NO: 336 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugucucuucgccucucucgtn

SEQ ID NO: 337 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaagagacaauugaagaaatn

SEQ ID NO: 338 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuucuucaauugucucuuctn

SEQ ID NO: 339 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuuagagccuauguggaugtn

SEQ ID NO: 340 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cauccacauaggcucuaaatn

SEQ ID NO: 341 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuagagccuauguggauggtn

SEQ ID NO: 342 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccauccacauaggcucuaatn

SEQ ID NO: 343 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uagagccuauguggauggatn

SEQ ID NO: 344 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uccauccacauaggcucuatn

SEQ ID NO: 345 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agagccuauguggauggautn

SEQ ID NO: 346 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auccauccacauaggcucutn

SEQ ID NO: 347 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gagccuauguggauggauutn

SEQ ID NO: 348 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aauccauccacauaggcuctn

SEQ ID NO: 349 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agccuauguggauggauuctn

SEQ ID NO: 350 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaauccauccacauaggcutn

SEQ ID NO: 351 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uaugaagcaauugaggagutn

SEQ ID NO: 352 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acuccucaauugcuucauatn

SEQ ID NO: 353 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
augaagcaauugaggagugtn

SEQ ID NO: 354 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cacuccucaauugcuucautn

SEQ ID NO: 355 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugaagcaauugaggagugctn

SEQ ID NO: 356 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcacuccucaauugcuucatn

SEQ ID NO: 357 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaagcaauugaggagugcctn

SEQ ID NO: 358 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggcacuccucaauugcuuctn

SEQ ID NO: 359 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aagcaauugaggagugccutn

SEQ ID NO: 360 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aggcacuccucaauugcuutn

SEQ ID NO: 361 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaucccuggguuuugcuuatn

SEQ ID NO: 362 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uaagcaaaacccagggauctn

SEQ ID NO: 363 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aucccuggguuuugcuuaatn

SEQ ID NO: 364 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuaagcaaaacccagggautn

SEQ ID NO: 365 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucccuggguuuugcuuaautn

SEQ ID NO: 366 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auuaagcaaaacccagggatn

SEQ ID NO: 367 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cccuggguuuugcuuaaugtn

SEQ ID NO: 368 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cauuaagcaaaacccagggtn

SEQ ID NO: 369 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccuggguuuugcuuaaugctn

SEQ ID NO: 370 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcauuaagcaaaacccaggtn

SEQ ID NO: 371 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuugguucaacuccuucctn

SEQ ID NO: 372 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggaaggaguugaaccaagatn

SEQ ID NO: 373 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuugguucaacuccuuccutn

SEQ ID NO: 374 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aggaaggaguugaaccaagtn

SEQ ID NO: 375 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaacgggacucuagcauactn

SEQ ID NO: 376 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guaugcuagagucccguuutn

SEQ ID NO: 377 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aacgggacucuagcauacutn

SEQ ID NO: 378 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aguaugcuagagucccguutn

SEQ ID NO: 379 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acgggacucuagcauacuutn

SEQ ID NO: 380 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaguaugcuagagucccgutn

SEQ ID NO: 381 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgggacucuagcauacuuatn

SEQ ID NO: 382 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uaaguaugcuagagucccgtn

SEQ ID NO: 383 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gggacucuagcauacuuactn

SEQ ID NO: 384 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guaaguaugcuagaguccctn

SEQ ID NO: 385 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggacucuagcauacuuacutn

SEQ ID NO: 386 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aguaaguaugcuagagucctn

SEQ ID NO: 387 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gacucuagcauacuuacugtn

SEQ ID NO: 388 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caguaaguaugcuagaguctn

SEQ ID NO: 389 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acucuagcauacuuacugatn

SEQ ID NO: 390 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucaguaaguaugcuagagutn

SEQ ID NO: 391 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cucuagcauacuuacugactn

SEQ ID NO: 392 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gucaguaaguaugcuagagtn

SEQ ID NO: 393 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuagcauacuuacugacatn

SEQ ID NO: 394 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugucaguaaguaugcuagatn

SEQ ID NO: 395 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuagcauacuuacugacagtn

SEQ ID NO: 396 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cugucaguaaguaugcuagtn

SEQ ID NO: 397 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uagcauacuuacugacagctn

SEQ ID NO: 398 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcugucaguaaguaugcuatn

SEQ ID NO: 399 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agcauacuuacugacagcctn

SEQ ID NO: 400 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggcugucaguaaguaugcutn

SEQ ID NO: 401 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcauacuuacugacagccatn

SEQ ID NO: 402 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uggcugucaguaaguaugctn

SEQ ID NO: 403 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cauacuuacugacagccagtn

SEQ ID NO: 404 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuggcugucaguaaguaugtn

SEQ ID NO: 405 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auacuuacugacagccagatn

SEQ ID NO: 406 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuggcugucaguaaguautn

SEQ ID NO: 407 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uacuuacugacagccagactn

SEQ ID NO: 408 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gucuggcugucaguaaguatn

SEQ ID NO: 409 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acuuacugacagccagacatn

SEQ ID NO: 410 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugucuggcugucaguaagutn

SEQ ID NO: 411 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuuacugacagccagacagtn

SEQ ID NO: 412 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cugucuggcugucaguaagtn

SEQ ID NO: 413 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuacugacagccagacagctn

SEQ ID NO: 414 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcugucuggcugucaguaatn

SEQ ID NO: 415 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uacugacagccagacagcgtn

SEQ ID NO: 416 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgcugucuggcugucaguatn

SEQ ID NO: 417 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acugacagccagacagcgatn

SEQ ID NO: 418 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucgcugucuggcugucagutn

SEQ ID NO: 419 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cugacagccagacagcgactn

SEQ ID NO: 420 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gucgcugucuggcugucagtn

SEQ ID NO: 421 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugacagccagacagcgacctn

SEQ ID NO: 422 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggucgcugucuggcugucatn

SEQ ID NO: 423 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gacagccagacagcgaccatn

SEQ ID NO: 424 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uggucgcugucuggcuguctn

SEQ ID NO: 425 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acagccagacagcgaccaatn

SEQ ID NO: 426 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuggucgcugucuggcugutn

SEQ ID NO: 427 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cagccagacagcgaccaaatn

SEQ ID NO: 428 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuuggucgcugucuggcugtn

SEQ ID NO: 429 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agccagacagcgaccaaaatn

SEQ ID NO: 430 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuuuggucgcugucuggcutn

SEQ ID NO: 431 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gccagacagcgaccaaaagtn

SEQ ID NO: 432 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuuuuggucgcugucuggctn

SEQ ID NO: 433 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cccgaucgugccuuccuuutn

SEQ ID NO: 434 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaaggaaggcacgaucgggtn

SEQ ID NO: 435 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccgaucgugccuuccuuugtn

SEQ ID NO: 436 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caaaggaaggcacgaucggtn

SEQ ID NO: 437 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgaucgugccuuccuuugatn

SEQ ID NO: 438 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucaaaggaaggcacgaucgtn

SEQ ID NO: 439 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaucgugccuuccuuugactn

SEQ ID NO: 440 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gucaaaggaaggcacgauctn

SEQ ID NO: 441 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aucgugccuuccuuugacatn

SEQ ID NO: 442 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugucaaaggaaggcacgautn

SEQ ID NO: 443 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucgugccuuccuuugacautn

SEQ ID NO: 444 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
augucaaaggaaggcacgatn

SEQ ID NO: 445 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgugccuuccuuugacaugtn

SEQ ID NO: 446 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caugucaaaggaaggcacgtn

SEQ ID NO: 447 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gugccuuccuuugacaugatn

SEQ ID NO: 448 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucaugucaaaggaaggcactn

SEQ ID NO: 449 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggaucuuauuucuucggagtn

SEQ ID NO: 450 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuccgaagaaauaagaucctn

SEQ ID NO: 451 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaucuuauuucuucggagatn

SEQ ID NO: 452 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuccgaagaaauaagauctn

SEQ ID NO: 453 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aucuuauuucuucggagactn

SEQ ID NO: 454 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gucuccgaagaaauaagautn

SEQ ID NO: 455 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuuauuucuucggagacatn

SEQ ID NO: 456 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugucuccgaagaaauaagatn

SEQ ID NO: 457 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuuauuucuucggagacaatn

SEQ ID NO: 458 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugucuccgaagaaauaagtn

SEQ ID NO: 459 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuauuucuucggagacaautn

SEQ ID NO: 460 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auugucuccgaagaaauaatn

SEQ ID NO: 461 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auuucuucggagacaaugctn

SEQ ID NO: 462 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcauugucuccgaagaaautn

SEQ ID NO: 463 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gggcggggagucuucgagctn

SEQ ID NO: 464 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcucgaagacuccccgccctn

SEQ ID NO: 465 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggcggggagucuucgagcutn

SEQ ID NO: 466 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agcucgaagacuccccgcctn

SEQ ID NO: 467 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcggggagucuucgagcuctn

SEQ ID NO: 468 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gagcucgaagacuccccgctn

SEQ ID NO: 469 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cggggagucuucgagcucutn

SEQ ID NO: 470 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agagcucgaagacuccccgtn

SEQ ID NO: 471 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggggagucuucgagcucuctn

SEQ ID NO: 472 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gagagcucgaagacucccctn

SEQ ID NO: 473 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugacgauggucauuuuguctn

SEQ ID NO: 474 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gacaaaaugaccaucgucatn

SEQ ID NO: 475 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gacgauggucauuuugucatn

SEQ ID NO: 476 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugacaaaaugaccaucguctn

SEQ ID NO: 477 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucccgucaggcccccucaatn

SEQ ID NO: 478 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugagggggccugacgggatn

SEQ ID NO: 479 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cccgucaggcccccucaaatn

SEQ ID NO: 480 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuugagggggccugacgggtn

SEQ ID NO: 481 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugagucuucuaaccgaggutn

SEQ ID NO: 482 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
accucgguuagaagacucatn

SEQ ID NO: 483 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gagucuucuaaccgagguctn

SEQ ID NO: 484 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaccucgguuagaagacuctn

SEQ ID NO: 485 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agucuucuaaccgaggucgtn

SEQ ID NO: 486 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgaccucgguuagaagacutn

SEQ ID NO: 487 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auuguggauucuugaucgutn

SEQ ID NO: 488 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acgaucaagaauccacaautn

SEQ ID NO: 489 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uggauucuugaucgucuuutn

SEQ ID NO: 490 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaagacgaucaagaauccatn

SEQ ID NO: 491 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gauucuugaucgucuuuuctn

SEQ ID NO: 492 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaaaagacgaucaagaauctn

SEQ ID NO: 493 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auucuugaucgucuuuucutn

SEQ ID NO: 494 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agaaaagacgaucaagaautn

SEQ ID NO: 495 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uucuugaucgucuuuucuutn

SEQ ID NO: 496 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aagaaaagacgaucaagaatn

SEQ ID NO: 497 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuugaucgucuuuucuuctn

SEQ ID NO: 498 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaagaaaagacgaucaagatn

SEQ ID NO: 499 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuugaucgucuuuucuucatn

SEQ ID NO: 500 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugaagaaaagacgaucaagtn

SEQ ID NO: 501 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugaucgucuuuucuucaatn

SEQ ID NO: 502 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugaagaaaagacgaucaatn

SEQ ID NO: 503 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugaucgucuuuucuucaaatn

SEQ ID NO: 504 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuugaagaaaagacgaucatn

SEQ ID NO: 505 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaucgucuuuucuucaaautn

SEQ ID NO: 506 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auuugaagaaaagacgauctn

SEQ ID NO: 507 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aucgucuuuucuucaaaugtn

SEQ ID NO: 508 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cauuugaagaaaagacgautn

SEQ ID NO: 509 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucgucuuuucuucaaaugctn

SEQ ID NO: 510 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcauuugaagaaaagacgatn

SEQ ID NO: 511 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgucuuuucuucaaaugcatn

SEQ ID NO: 512 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugcauuugaagaaaagacgtn

SEQ ID NO: 513 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gucuuuucuucaaaugcautn

SEQ ID NO: 514 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
augcauuugaagaaaagactn

SEQ ID NO: 515 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuuuucuucaaaugcauutn

SEQ ID NO: 516 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaugcauuugaagaaaagatn

SEQ ID NO: 517 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuuuucuucaaaugcauuutn

SEQ ID NO: 518 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaaugcauuugaagaaaagtn

SEQ ID NO: 519 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuuucuucaaaugcauuuatn

SEQ ID NO: 520 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uaaaugcauuugaagaaaatn

SEQ ID NO: 521 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuucuucaaaugcauuuautn

SEQ ID NO: 522 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auaaaugcauuugaagaaatn

SEQ ID NO: 523 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uucuucaaaugcauuuauctn

SEQ ID NO: 524 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gauaaaugcauuugaagaatn

SEQ ID NO: 525 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuucaaaugcauuuaucgtn

SEQ ID NO: 526 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgauaaaugcauuugaagatn

SEQ ID NO: 527 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuucaaaugcauuuaucgutn

SEQ ID NO: 528 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acgauaaaugcauuugaagtn

SEQ ID NO: 529 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uucaaaugcauuuaucguctn

SEQ ID NO: 530 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gacgauaaaugcauuugaatn

SEQ ID NO: 531 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuaaauacgguuugaaaagtn

SEQ ID NO: 532 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuuuucaaaccguauuuaatn

SEQ ID NO: 533 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uaaauacgguuugaaaagatn

SEQ ID NO: 534 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuuuucaaaccguauuuatn

SEQ ID NO: 535 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaauacgguuugaaaagagtn

SEQ ID NO: 536 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cucuuuucaaaccguauuutn

SEQ ID NO: 537 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aauacgguuugaaaagaggtn

SEQ ID NO: 538 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccucuuuucaaaccguauutn

SEQ ID NO: 539 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugaaaagagggccuucuatn

SEQ ID NO: 540 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uagaaggcccucuuuucaatn

SEQ ID NO: 541 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugaaaagagggccuucuactn

SEQ ID NO: 542 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guagaaggcccucuuuucatn

SEQ ID NO: 543 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaaaagagggccuucuacgtn

SEQ ID NO: 544 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cguagaaggcccucuuuuctn

SEQ ID NO: 545 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccugagucuaugagggaagtn

SEQ ID NO: 546 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuucccucauagacucaggtn

SEQ ID NO: 547 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cugagucuaugagggaagatn

SEQ ID NO: 548 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuucccucauagacucagtn

SEQ ID NO: 549 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugcuguggauguugacgautn

SEQ ID NO: 550 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aucgucaacauccacagcatn

SEQ ID NO: 551 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcuguggauguugacgaugtn

SEQ ID NO: 552 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caucgucaacauccacagctn

SEQ ID NO: 553 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuguggauguugacgauggtn

SEQ ID NO: 554 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccaucgucaacauccacagtn

SEQ ID NO: 555 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uguggauguugacgauggutn

SEQ ID NO: 556 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
accaucgucaacauccacatn

SEQ ID NO: 557 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guggauguugacgaugguctn

SEQ ID NO: 558 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaccaucgucaacauccactn

SEQ ID NO: 559 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uggauguugacgauggucatn

SEQ ID NO: 560 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugaccaucgucaacauccatn

SEQ ID NO: 561 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggauguugacgauggucautn

SEQ ID NO: 562 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
augaccaucgucaacaucctn

SEQ ID NO: 563 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gauguugacgauggucauutn

SEQ ID NO: 564 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaugaccaucgucaacauctn

SEQ ID NO: 565 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auguugacgauggucauuutn

SEQ ID NO: 566 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaaugaccaucgucaacautn

SEQ ID NO: 567 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uguugacgauggucauuuutn

SEQ ID NO: 568 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaaaugaccaucgucaacatn

SEQ ID NO: 569 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guugacgauggucauuuugtn

SEQ ID NO: 570 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caaaaugaccaucgucaactn

SEQ ID NO: 571 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugacgauggucauuuugutn

SEQ ID NO: 572 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acaaaaugaccaucgucaatn

SEQ ID NO: 573 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acgauggucauuuugucaatn

SEQ ID NO: 574 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugacaaaaugaccaucgutn

SEQ ID NO: 575 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgauggucauuuugucaactn

SEQ ID NO: 576 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guugacaaaaugaccaucgtn

SEQ ID NO: 577 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gauggucauuuugucaacatn

SEQ ID NO: 578 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uguugacaaaaugaccauctn

SEQ ID NO: 579 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auggucauuuugucaacautn

SEQ ID NO: 580 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auguugacaaaaugaccautn

SEQ ID NO: 581 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uggucauuuugucaacauatn

SEQ ID NO: 582 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uauguugacaaaaugaccatn

SEQ ID NO: 583 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggucauuuugucaacauagtn

SEQ ID NO: 584 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuauguugacaaaaugacctn

SEQ ID NO: 585 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gucauuuugucaacauagatn

SEQ ID NO: 586 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuauguugacaaaaugactn

SEQ ID NO: 587 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucaaggcaccaaacgaucutn

SEQ ID NO: 588 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agaucguuuggugccuugatn

SEQ ID NO: 589 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caaggcaccaaacgaucuutn

SEQ ID NO: 590 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aagaucguuuggugccuugtn

SEQ ID NO: 591 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaggcaccaaacgaucuuatn

SEQ ID NO: 592 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uaagaucguuuggugccuutn

SEQ ID NO: 593 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aacagcauaacaauagagatn

SEQ ID NO: 594 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucucuauuguuaugcuguutn

SEQ ID NO: 595 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acagcauaacaauagagagtn

SEQ ID NO: 596 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cucucuauuguuaugcugutn

SEQ ID NO: 597 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cagcauaacaauagagagatn

SEQ ID NO: 598 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucucucuauuguuaugcugtn

SEQ ID NO: 599 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agcauaacaauagagagaatn

SEQ ID NO: 600 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uucucucuauuguuaugcutn

SEQ ID NO: 601 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcauaacaauagagagaautn

SEQ ID NO: 602 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auucucucuauuguuaugctn

SEQ ID NO: 603 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cauaacaauagagagaaugtn

SEQ ID NO: 604 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cauucucucuauuguuaugtn

SEQ ID NO: 605 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auugcauaugagagaaugutn

SEQ ID NO: 606 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acauucucucauaugcaautn

SEQ ID NO: 607 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugcauaugagagaaugugtn

SEQ ID NO: 608 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cacauucucucauaugcaatn

SEQ ID NO: 609 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcauaugagagaaugugcatn

SEQ ID NO: 610 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugcacauucucucauaugctn

SEQ ID NO: 611 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cauaugagagaaugugcaatn

SEQ ID NO: 612 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugcacauucucucauaugtn

SEQ ID NO: 613 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gggagucuucgagcucucgtn

SEQ ID NO: 614 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgagagcucgaagacuccctn

SEQ ID NO: 615 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggagucuucgagcucucggtn

SEQ ID NO: 616 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccgagagcucgaagacucctn

SEQ ID NO: 617 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gagucuucgagcucucggatn

SEQ ID NO: 618 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uccgagagcucgaagacuctn

SEQ ID NO: 619 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agucuucgagcucucggactn

SEQ ID NO: 620 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guccgagagcucgaagacutn

SEQ ID NO: 621 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gucuucgagcucucggacgtn

SEQ ID NO: 622 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cguccgagagcucgaagactn

SEQ ID NO: 623 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuucgagcucucggacgatn

SEQ ID NO: 624 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucguccgagagcucgaagatn

SEQ ID NO: 625 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuucgagcucucggacgaatn

SEQ ID NO: 626 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uucguccgagagcucgaagtn

SEQ ID NO: 627 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uucgagcucucggacgaaatn

SEQ ID NO: 628 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuucguccgagagcucgaatn

SEQ ID NO: 629 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgagcucucggacgaaaagtn

SEQ ID NO: 630 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuuuucguccgagagcucgtn

SEQ ID NO: 631 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gagcucucggacgaaaaggtn

SEQ ID NO: 632 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccuuuucguccgagagcuctn

SEQ ID NO: 633 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agcucucggacgaaaaggctn

SEQ ID NO: 634 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gccuuuucguccgagagcutn

SEQ ID NO: 635 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcucucggacgaaaaggcatn

SEQ ID NO: 636 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugccuuuucguccgagagctn

SEQ ID NO: 637 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cucucggacgaaaaggcaatn

SEQ ID NO: 638 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugccuuuucguccgagagtn

SEQ ID NO: 639 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucucggacgaaaaggcaactn

SEQ ID NO: 640 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guugccuuuucguccgagatn

SEQ ID NO: 641 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cucggacgaaaaggcaacgtn

SEQ ID NO: 642 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cguugccuuuucguccgagtn

SEQ ID NO: 643 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucggacgaaaaggcaacgatn

SEQ ID NO: 644 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucguugccuuuucguccgatn

SEQ ID NO: 645 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cggacgaaaaggcaacgaatn

SEQ ID NO: 646 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uucguugccuuuucguccgtn

SEQ ID NO: 647 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggacgaaaaggcaacgaactn

SEQ ID NO: 648 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guucguugccuuuucgucctn

SEQ ID NO: 649 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gacgaaaaggcaacgaacctn

SEQ ID NO: 650 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gguucguugccuuuucguctn

SEQ ID NO: 651 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acgaaaaggcaacgaaccctn

SEQ ID NO: 652 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggguucguugccuuuucgutn

SEQ ID NO: 653 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgaaaaggcaacgaacccgtn

SEQ ID NO: 654 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cggguucguugccuuuucgtn

SEQ ID NO: 655 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaaaggcaacgaacccgautn

SEQ ID NO: 656 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aucggguucguugccuuuutn

SEQ ID NO: 657 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaaggcaacgaacccgauctn

SEQ ID NO: 658 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaucggguucguugccuuutn

SEQ ID NO: 659 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaggcaacgaacccgaucgtn

SEQ ID NO: 660 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgaucggguucguugccuutn

SEQ ID NO: 661 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acgaacccgaucgugccuutn

SEQ ID NO: 662 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaggcacgaucggguucgutn

SEQ ID NO: 663 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgaacccgaucgugccuuctn

SEQ ID NO: 664 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaaggcacgaucggguucgtn

SEQ ID NO: 665 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaacccgaucgugccuucctn

SEQ ID NO: 666 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggaaggcacgaucggguuctn

SEQ ID NO: 667 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aacccgaucgugccuuccutn

SEQ ID NO: 668 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aggaaggcacgaucggguutn

SEQ ID NO: 669 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acccgaucgugccuuccuutn

SEQ ID NO: 670 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaggaaggcacgaucgggutn

SEQ ID NO: 671 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auggaugucaauccgacuutn

SEQ ID NO: 672 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aagucggauugacauccautn

SEQ ID NO: 673 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uggaugucaauccgacuuutn

SEQ ID NO: 674 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaagucggauugacauccatn

SEQ ID NO: 675 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaugucaauccgacuuuactn

SEQ ID NO: 676 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guaaagucggauugacauctn

SEQ ID NO: 677 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
augucaauccgacuuuacutn

SEQ ID NO: 678 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aguaaagucggauugacautn

SEQ ID NO: 679 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugucaauccgacuuuacuutn

SEQ ID NO: 680 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaguaaagucggauugacatn

SEQ ID NO: 681 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccauacagccauggaacagtn

SEQ ID NO: 682 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuguuccauggcuguauggtn

SEQ ID NO: 683 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cauacagccauggaacaggtn

SEQ ID NO: 684 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccuguuccauggcuguaugtn

SEQ ID NO: 685 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acaggauacaccauggacatn

SEQ ID NO: 686 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uguccaugguguauccugutn

SEQ ID NO: 687 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caggauacaccauggacactn

SEQ ID NO: 688 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guguccaugguguauccugtn

SEQ ID NO: 689 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuggaagcaauggcuuucctn

SEQ ID NO: 690 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggaaagccauugcuuccaatn

SEQ ID NO: 691 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggaagcaauggcuuuccuutn

SEQ ID NO: 692 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaggaaagccauugcuucctn

SEQ ID NO: 693 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agcaauggcuuuccuugaatn

SEQ ID NO: 694 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uucaaggaaagccauugcutn

SEQ ID NO: 695 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
augaugacuaacucacaagtn

SEQ ID NO: 696 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuugugaguuagucaucautn

SEQ ID NO: 697 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugaugacuaacucacaagatn

SEQ ID NO: 698 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuugugaguuagucaucatn

SEQ ID NO: 699 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
accaaauggaaugagaauctn

SEQ ID NO: 700 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gauucucauuccauuuggutn

SEQ ID NO: 701 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccaaauggaaugagaaucatn

SEQ ID NO: 702 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugauucucauuccauuuggtn

SEQ ID NO: 703 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggaaugaugaugggcaugutn

SEQ ID NO: 704 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acaugcccaucaucauucctn

SEQ ID NO: 705 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaaugaugaugggcauguutn

SEQ ID NO: 706 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aacaugcccaucaucauuctn

SEQ ID NO: 707 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuccaauccucugaugauutn

SEQ ID NO: 708 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaucaucagaggauuggagtn

SEQ ID NO: 709 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uccaauccucugaugauuutn

SEQ ID NO: 710 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaaucaucagaggauuggatn

SEQ ID NO: 711 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aucaugagggaauacaagctn

SEQ ID NO: 712 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcuuguauucccucaugautn

SEQ ID NO: 713 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuugugcgacaaugcuucatn

SEQ ID NO: 714 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugaagcauugucgcacaaatn

SEQ ID NO: 715 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uaugggauuccuuucgucatn

SEQ ID NO: 716 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugacgaaaggaaucccauatn

SEQ ID NO: 717 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uccgagagaggcgaagagatn

SEQ ID NO: 718 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucucuucgccucucucggatn

SEQ ID NO: 719 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccgagagaggcgaagagactn

SEQ ID NO: 720 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gucucuucgccucucucggtn

SEQ ID NO: 721 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gagagaggcgaagagacaatn

SEQ ID NO: 722 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugucucuucgccucucuctn

SEQ ID NO: 723 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agagaggcgaagagacaautn

SEQ ID NO: 724 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auugucucuucgccucucutn

SEQ ID NO: 725 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gagaggcgaagagacaauutn

SEQ ID NO: 726 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aauugucucuucgccucuctn

SEQ ID NO: 727 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agaggcgaagagacaauugtn

SEQ ID NO: 728 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caauugucucuucgccucutn

SEQ ID NO: 729 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaggcgaagagacaauugatn

SEQ ID NO: 730 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucaauugucucuucgccuctn

SEQ ID NO: 731 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aggcgaagagacaauugaatn

SEQ ID NO: 732 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uucaauugucucuucgccutn

SEQ ID NO: 733 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggcgaagagacaauugaagtn

SEQ ID NO: 734 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuucaauugucucuucgcctn

SEQ ID NO: 735 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcgaagagacaauugaagatn

SEQ ID NO: 736 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuucaauugucucuucgctn

SEQ ID NO: 737 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgaagagacaauugaagaatn

SEQ ID NO: 738 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uucuucaauugucucuucgtn

SEQ ID NO: 739 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uucuccagccuugaaaacutn

SEQ ID NO: 740 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aguuuucaaggcuggagaatn

SEQ ID NO: 741 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuccagccuugaaaacuutn

SEQ ID NO: 742 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaguuuucaaggcuggagatn

SEQ ID NO: 743 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuccagccuugaaaacuuutn

SEQ ID NO: 744 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaaguuuucaaggcuggagtn

SEQ ID NO: 745 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uccagccuugaaaacuuuatn

SEQ ID NO: 746 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uaaaguuuucaaggcuggatn

SEQ ID NO: 747 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccagccuugaaaacuuuagtn

SEQ ID NO: 748 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuaaaguuuucaaggcuggtn

SEQ ID NO: 749 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cagccuugaaaacuuuagatn

SEQ ID NO: 750 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucuaaaguuuucaaggcugtn

SEQ ID NO: 751 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agccuugaaaacuuuagagtn

SEQ ID NO: 752 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cucuaaaguuuucaaggcutn

SEQ ID NO: 753 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gccuugaaaacuuuagagctn

SEQ ID NO: 754 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcucuaaaguuuucaaggctn

SEQ ID NO: 755 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccuugaaaacuuuagagcctn

SEQ ID NO: 756 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggcucuaaaguuuucaaggtn

SEQ ID NO: 757 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuugaaaacuuuagagccutn

SEQ ID NO: 758 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aggcucuaaaguuuucaagtn

SEQ ID NO: 759 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugaaaacuuuagagccuatn

SEQ ID NO: 760 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uaggcucuaaaguuuucaatn

SEQ ID NO: 761 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugaaaacuuuagagccuautn

SEQ ID NO: 762 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auaggcucuaaaguuuucatn

SEQ ID NO: 763 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaaaacuuuagagccuaugtn

SEQ ID NO: 764 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cauaggcucuaaaguuuuctn

SEQ ID NO: 765 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaaacuuuagagccuaugutn

SEQ ID NO: 766 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acauaggcucuaaaguuuutn

SEQ ID NO: 767 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaacuuuagagccuaugugtn

SEQ ID NO: 768 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cacauaggcucuaaaguuutn

SEQ ID NO: 769 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aacuuuagagccuauguggtn

SEQ ID NO: 770 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccacauaggcucuaaaguutn

SEQ ID NO: 771 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acuuuagagccuauguggatn

SEQ ID NO: 772 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uccacauaggcucuaaagutn

SEQ ID NO: 773 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuuuagagccuauguggautn

SEQ ID NO: 774 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auccacauaggcucuaaagtn

SEQ ID NO: 775 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaccgaacggcugcauugatn

SEQ ID NO: 776 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucaaugcagccguucgguutn

SEQ ID NO: 777 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
accgaacggcugcauugagtn

SEQ ID NO: 778 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cucaaugcagccguucggutn

SEQ ID NO: 779 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccgaacggcugcauugaggtn

SEQ ID NO: 780 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccucaaugcagccguucggtn

SEQ ID NO: 781 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cgaacggcugcauugagggtn

SEQ ID NO: 782 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cccucaaugcagccguucgtn

SEQ ID NO: 783 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaacggcugcauugagggctn

SEQ ID NO: 784 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcccucaaugcagccguuctn

SEQ ID NO: 785 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aacggcugcauugagggcatn

SEQ ID NO: 786 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugcccucaaugcagccguutn

SEQ ID NO: 787 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acggcugcauugagggcaatn

SEQ ID NO: 788 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugcccucaaugcagccgutn

SEQ ID NO: 789 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cggcugcauugagggcaagtn

SEQ ID NO: 790 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuugcccucaaugcagccgtn

SEQ ID NO: 791 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggcugcauugagggcaagctn

SEQ ID NO: 792 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcuugcccucaaugcagcctn

SEQ ID NO: 793 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcugcauugagggcaagcutn

SEQ ID NO: 794 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agcuugcccucaaugcagctn

SEQ ID NO: 795 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cugcauugagggcaagcuutn

SEQ ID NO: 796 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aagcuugcccucaaugcagtn

SEQ ID NO: 797 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugcauugagggcaagcuuutn

SEQ ID NO: 798 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaagcuugcccucaaugcatn

SEQ ID NO: 799 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcauugagggcaagcuuuctn

SEQ ID NO: 800 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaaagcuugcccucaaugctn

SEQ ID NO: 801 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cauugagggcaagcuuucutn

SEQ ID NO: 802 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agaaagcuugcccucaaugtn

SEQ ID NO: 803 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auugagggcaagcuuucuctn

SEQ ID NO: 804 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gagaaagcuugcccucaautn

SEQ ID NO: 805 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugagggcaagcuuucucatn

SEQ ID NO: 806 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugagaaagcuugcccucaatn

SEQ ID NO: 807 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugagggcaagcuuucucaatn

SEQ ID NO: 808 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugagaaagcuugcccucatn

SEQ ID NO: 809 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gagggcaagcuuucucaaatn

SEQ ID NO: 810 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuugagaaagcuugcccuctn

SEQ ID NO: 811 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agggcaagcuuucucaaautn

SEQ ID NO: 812 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auuugagaaagcuugcccutn

SEQ ID NO: 813 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gggcaagcuuucucaaaugtn

SEQ ID NO: 814 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cauuugagaaagcuugccctn

SEQ ID NO: 815 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggcaagcuuucucaaaugutn

SEQ ID NO: 816 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acauuugagaaagcuugcctn

SEQ ID NO: 817 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcaagcuuucucaaauguctn

SEQ ID NO: 818 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gacauuugagaaagcuugctn

SEQ ID NO: 819 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
augauaagcaaaugcagaatn

SEQ ID NO: 820 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uucugcauuugcuuaucautn

SEQ ID NO: 821 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugauaagcaaaugcagaactn

SEQ ID NO: 822 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guucugcauuugcuuaucatn

SEQ ID NO: 823 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuuagggacaaccuggaactn

SEQ ID NO: 824 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
guuccagguugucccuaagtn

SEQ ID NO: 825 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuagggacaaccuggaacctn

SEQ ID NO: 826 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gguuccagguugucccuaatn

SEQ ID NO: 827 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uagggacaaccuggaaccutn

SEQ ID NO: 828 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agguuccagguugucccuatn

SEQ ID NO: 829 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agggacaaccuggaaccugtn

SEQ ID NO: 830 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cagguuccagguugucccutn

SEQ ID NO: 831 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gggacaaccuggaaccuggtn

SEQ ID NO: 832 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ccagguuccagguuguccctn

SEQ ID NO: 833 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agcaauugaggagugccugtn

SEQ ID NO: 834 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caggcacuccucaauugcutn

SEQ ID NO: 835 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcaauugaggagugccugatn

SEQ ID NO: 836 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ucaggcacuccucaauugctn

SEQ ID NO: 837 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
caauugaggagugccugautn

SEQ ID NO: 838 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aucaggcacuccucaauugtn

SEQ ID NO: 839 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aauugaggagugccugauutn

SEQ ID NO: 840 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaucaggcacuccucaauutn

SEQ ID NO: 841 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
auugaggagugccugauuatn

SEQ ID NO: 842 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uaaucaggcacuccucaautn

SEQ ID NO: 843 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugaggagugccugauuaatn

SEQ ID NO: 844 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uuaaucaggcacuccucaatn

SEQ ID NO: 845 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uugguucaacuccuuccuctn

SEQ ID NO: 846 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaggaaggaguugaaccaatn

SEQ ID NO: 847 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaaugaaauggaugauggctn

SEQ ID NO: 848 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gccaucauccauuucauuctn

SEQ ID NO: 849 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugguaaugaaacggaaacgtn

SEQ ID NO: 850 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cguuuccguuucauuaccatn

SEQ ID NO: 851 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
augaaacggaaacgggacutn

SEQ ID NO: 852 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agucccguuuccguuucautn

SEQ ID NO: 853 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugaaacggaaacgggacuctn

SEQ ID NO: 854 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gagucccguuuccguuucatn

SEQ ID NO: 855 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gaaacggaaacgggacucutn

SEQ ID NO: 856 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
agagucccguuuccguuuctn

SEQ ID NO: 857 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aaacggaaacgggacucuatn

SEQ ID NO: 858 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
uagagucccguuuccguuutn

SEQ ID NO: 859 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
aacggaaacgggacucuagtn

SEQ ID NO: 860 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cuagagucccguuuccguutn

SEQ ID NO: 861 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
acggaaacgggacucuagctn

SEQ ID NO: 862 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
gcuagagucccguuuccgutn

SEQ ID NO: 863 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
cggaaacgggacucuagcatn

SEQ ID NO: 864 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ugcuagagucccguuuccgtn

SEQ ID NO: 865 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
ggaaacgggacucuagcautn

SEQ ID NO: 866 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (21)..(21): thymidine 5'-phosphorothioate
augcuagagucccguuucctn

SEQ ID NO: 867 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
  modified_base (6)..(6): Universal base (Nitropyrrolyl and nitroindolyl)
  modified_base (9)..(9): Universal base (Nitropyrrolyl and nitroindolyl)
ucngcnganaugagcauugtt

SEQ ID NO: 868 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
  modified_base (14)..(14): Universal base (Nitropyrrolyl and nitroindolyl)
  modified_base (17)..(17): Universal base (Nitropyrrolyl and nitroindolyl)
caaugcucaunucngcngatt

SEQ ID NO: 869 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
  modified_base (5)..(5): Universal base (Nitropyrrolyl and nitroindolyl)
  modified_base (8)..(8): Universal base (Nitropyrrolyl and nitroindolyl)
cngcnganaugagcauuggtt

SEQ ID NO: 870 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
  modified_base (15)..(15): Universal base (Nitropyrrolyl and nitroindolyl)
  modified_base (18)..(18): Universal base (Nitropyrrolyl and nitroindolyl)
ccaaugcucaunucngcngtt

SEQ ID NO: 871 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
  modified_base (10)..(10): Universal base (Nitropyrrolyl and nitroindolyl)
naagaucugnuccaccauutt

SEQ ID NO: 872 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
  modified_base (19)..(19): Universal base (Nitropyrrolyl and nitroindolyl)
aaugguggancagaucuuntt

SEQ ID NO: 873 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
aagaucugnuccaccauugtt

SEQ ID NO: 874 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
caaugguggancagaucuutt

SEQ ID NO: 875 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
  modified_base (19)..(19): Universal base (Nitropyrrolyl and nitroindolyl)
agaucugnuccaccauugntt

SEQ ID NO: 876 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
  modified_base (12)..(12): Universal base (Nitropyrrolyl and nitroindolyl)
ncaaugguggancagaucutt

SEQ ID NO: 877 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
  modified_base (9)..(10): Universal base (Nitropyrrolyl and nitroindolyl)
nugaauuunncuuguccuutt

SEQ ID NO: 878 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(11): Universal base (Nitropyrrolyl and nitroindolyl)
  modified_base (19)..(19): Universal base (Nitropyrrolyl and nitroindolyl)
aaggacaagnnaaauucantt

SEQ ID NO: 879 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(9): Universal base (Nitropyrrolyl and nitroindolyl)
ugaauuunncuuguccuuctt

SEQ ID NO: 880 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(12): Universal base (Nitropyrrolyl and nitroindolyl)
gaaggacaagnnaaauucatt

SEQ ID NO: 881 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(8): Universal base (Nitropyrrolyl and nitroindolyl)
  modified_base (19)..(19): Universal base (Nitropyrrolyl and nitroindolyl)
gaauuunncuuguccuucntt

SEQ ID NO: 882 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
  modified_base (12)..(13): Universal base (Nitropyrrolyl and nitroindolyl)
ngaaggacaagnnaaauuctt

SEQ ID NO: 883 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
uuguccuucnugaaaaaautt

SEQ ID NO: 884 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
auuuuuucangaaggacaatt

SEQ ID NO: 885 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
uguccuucnugaaaaaaugtt

SEQ ID NO: 886 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
cauuuuuucangaaggacatt

SEQ ID NO: 887 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
guccuucnugaaaaaaugctt

SEQ ID NO: 888 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
gcauuuuuucangaaggactt

SEQ ID NO: 889 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(7): Universal base (Nitropyrrolyl and nitroindolyl)
  modified_base (19)..(19): Universal base (Nitropyrrolyl and nitroindolyl)
uccuucnugaaaaaaugcntt

SEQ ID NO: 890 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
  modified_base (13)..(13): Universal base (Nitropyrrolyl and nitroindolyl)
ngcauuuuuucangaaggatt

SEQ ID NO: 891 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
  modified_base (6)..(6): Universal base (Nitropyrrolyl and nitroindolyl)
  modified_base (9)..(9): Universal base (Nitropyrrolyl and nitroindolyl)
aanggnugnauugagggcatt

SEQ ID NO: 892 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
  modified_base (14)..(14): Universal base (Nitropyrrolyl and nitroindolyl)
  modified_base (17)..(17): Universal base (Nitropyrrolyl and nitroindolyl)
ugcccucaauncanccnuutt

SEQ ID NO: 893 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
  modified_base (5)..(5): Universal base (Nitropyrrolyl and nitroindolyl)
  modified_base (8)..(8): Universal base (Nitropyrrolyl and nitroindolyl)
anggnugnauugagggcaatt

SEQ ID NO: 894 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
  modified_base (15)..(15): Universal base (Nitropyrrolyl and nitroindolyl)
  modified_base (18)..(18): Universal base (Nitropyrrolyl and nitroindolyl)
uugcccucaauncanccnutt

SEQ ID NO: 895 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
  modified_base (4)..(4): Universal base (Nitropyrrolyl and nitroindolyl)
  modified_base (7)..(7): Universal base (Nitropyrrolyl and nitroindolyl)
nggnugnauugagggcaagtt

SEQ ID NO: 896 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(13): Universal base (Nitropyrrolyl and nitroindolyl)
  modified_base (16)..(16): Universal base (Nitropyrrolyl and nitroindolyl)
  modified_base (19)..(19): Universal base (Nitropyrrolyl and nitroindolyl)
cuugcccucaauncanccntt

SEQ ID NO: 897 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
  modified_base (6)..(6): Universal base (Nitropyrrolyl and nitroindolyl)
ggnugnauugagggcaagctt

SEQ ID NO: 898 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
  modified_base (17)..(17): Universal base (Nitropyrrolyl and nitroindolyl)
gcuugcccucaauncancctt

SEQ ID NO: 899 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
  modified_base (5)..(5): Universal base (Nitropyrrolyl and nitroindolyl)
gnugnauugagggcaagcutt

SEQ ID NO: 900 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
  modified_base (18)..(18): Universal base (Nitropyrrolyl and nitroindolyl)
agcuugcccucaauncanctt

SEQ ID NO: 901 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
  modified_base (4)..(4): Universal base (Nitropyrrolyl and nitroindolyl)
nugnauugagggcaagcuwtt

SEQ ID NO: 902 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): Universal base (Nitropyrrolyl and nitroindolyl)
  modified_base (19)..(19): Universal base (Nitropyrrolyl and nitroindolyl)
wagcuugcccucaauncantt

SEQ ID NO: 903 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
  modified_base (10)..(10): Universal base (Nitropyrrolyl and nitroindolyl)
aangcuacunuuugcuauctt

SEQ ID NO: 904 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
  modified_base (17)..(17): Universal base (Nitropyrrolyl and nitroindolyl)
gauagcaaanaguagcnuutt

SEQ ID NO: 905 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
  modified_base (9)..(9): Universal base (Nitropyrrolyl and nitroindolyl)
angcuacunuuugcuaucctt

SEQ ID NO: 906 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
  modified_base (18)..(18): Universal base (Nitropyrrolyl and nitroindolyl)
ggauagcaaanaguagcnutt

SEQ ID NO: 907 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
  modified_base (8)..(8): Universal base (Nitropyrrolyl and nitroindolyl)
ngcuacunuuugcuauccatt

SEQ ID NO: 908 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
  modified_base (19)..(19): Universal base (Nitropyrrolyl and nitroindolyl)
uggauagcaaanaguagcntt

SEQ ID NO: 909 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(7): Universal base (Nitropyrrolyl and nitroindolyl)
gcuacunuuugcuauccautt

SEQ ID NO: 910 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(13): Universal base (Nitropyrrolyl and nitroindolyl)
auggauagcaaanaguagctt

SEQ ID NO: 911 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
cuacunuuugcuauccauatt

SEQ ID NO: 912 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
uauggauagcaaanaguagtt

SEQ ID NO: 913 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
uacunuuugcuauccauactt

SEQ ID NO: 914 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
guauggauagcaaanaguatt

SEQ ID NO: 915 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): Universal base (Nitropyrrolyl and nitroindolyl)
acunuuugcuauccauacutt

SEQ ID NO: 916 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): Universal base (Nitropyrrolyl and nitroindolyl)
aguauggauagcaaanagutt

SEQ ID NO: 917 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
cunuuugcuauccauacugtt

SEQ ID NO: 918 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
caguauggauagcaaanagtt

SEQ ID NO: 919 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
unuuugcuauccauacugutt

SEQ ID NO: 920 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
acaguauggauagcaaanatt

SEQ ID NO: 921 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nuuugcuauccauacuguctt

SEQ ID NO: 922 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
gacaguauggauagcaaantt

SEQ ID NO: 923 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
uuugcuauccauacugucntt

SEQ ID NO: 924 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
ngacaguauggauagcaaatt

SEQ ID NO: 925 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(8): Universal base (Nitropyrrolyl and nitroindolyl)
  modified_base (10)..(10): Universal base (Nitropyrrolyl and nitroindolyl)
ucggccnncnaaagcaggutt

SEQ ID NO: 926 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
  modified_base (12)..(13): Universal base (Nitropyrrolyl and nitroindolyl)
accugcuuungnnggccgatt

SEQ ID NO: 927 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(7): Universal base (Nitropyrrolyl and nitroindolyl)
  modified_base (9)..(9): Universal base (Nitropyrrolyl and nitroindolyl)
cggccnncnaaagcagguctt

SEQ ID NO: 928 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
  modified_base (13)..(14): Universal base (Nitropyrrolyl and nitroindolyl)
gaccugcuuungnnggccgtt

SEQ ID NO: 929 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(6): Universal base (Nitropyrrolyl and nitroindolyl)
  modified_base (8)..(8): Universal base (Nitropyrrolyl and nitroindolyl)
ggccnncnaaagcaggucatt

SEQ ID NO: 930 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
  modified_base (14)..(15): Universal base (Nitropyrrolyl and nitroindolyl)
ugaccugcuuungnnggcctt

SEQ ID NO: 931 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(5): Universal base (Nitropyrrolyl and nitroindolyl)
  modified_base (7)..(7): Universal base (Nitropyrrolyl and nitroindolyl)
gccnncnaaagcaggucaatt

SEQ ID NO: 932 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(13): Universal base (Nitropyrrolyl and nitroindolyl)
  modified_base (15)..(16): Universal base (Nitropyrrolyl and nitroindolyl)
uugaccugcuuungnnggctt

SEQ ID NO: 933 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
  modified_base (10)..(10): Universal base (Nitropyrrolyl and nitroindolyl)
gacagncagncagcgaccatt

SEQ ID NO: 934 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
  modified_base (14)..(14): Universal base (Nitropyrrolyl and nitroindolyl)
uggucgcugncugncuguctt

SEQ ID NO: 935 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
  modified_base (9)..(9): Universal base (Nitropyrrolyl and nitroindolyl)
  modified_base (19)..(19): Universal base (Nitropyrrolyl and nitroindolyl)
acagncagncagcgaccantt

SEQ ID NO: 936 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
  modified_base (11)..(11): Universal base (Nitropyrrolyl and nitroindolyl)
  modified_base (15)..(15): Universal base (Nitropyrrolyl and nitroindolyl)
nuggucgcugncugncugutt

SEQ ID NO: 937 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
  modified_base (3)..(3): Universal base (Nitropyrrolyl and nitroindolyl)
  modified_base (10)..(10): Universal base (Nitropyrrolyl and nitroindolyl)
nunuhgaaunguuuaaaaatt

SEQ ID NO: 938 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
  modified_base (17)..(17): Universal base (Nitropyrrolyl and nitroindolyl)
  modified_base (19)..(19): Universal base (Nitropyrrolyl and nitroindolyl)
uuuuuaaacnauuchanantt

SEQ ID NO: 939 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): Universal base (Nitropyrrolyl and nitroindolyl)
  modified_base (9)..(9): Universal base (Nitropyrrolyl and nitroindolyl)
ugungaaunguuuaaaaactt

SEQ ID NO: 940 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
  modified_base (16)..(16): Universal base (Nitropyrrolyl and nitroindolyl)
guuuuuaaacnauucnacatt

SEQ ID NO: 941 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
  modified_base (8)..(8): Universal base (Nitropyrrolyl and nitroindolyl)
gungaaunguuuaaaaacstt

SEQ ID NO: 942 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
  modified_base (17)..(17): Universal base (Nitropyrrolyl and nitroindolyl)
sguuuuuaaacnauucnactt

SEQ ID NO: 943 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(10): Universal base (Nitropyrrolyl and nitroindolyl)
uguuucunnnauauggcgctt

SEQ ID NO: 944 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(12): Universal base (Nitropyrrolyl and nitroindolyl)
gcgccauaunnnagaaacatt

SEQ ID NO: 945 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(9): Universal base (Nitropyrrolyl and nitroindolyl)
guuucunnnauauggcgcatt

SEQ ID NO: 946 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(13): Universal base (Nitropyrrolyl and nitroindolyl)
ugcgccauaunnnagaaactt

SEQ ID NO: 947 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(8): Universal base (Nitropyrrolyl and nitroindolyl)
uuucunnnauauggcgcautt

SEQ ID NO: 948 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(14): Universal base (Nitropyrrolyl and nitroindolyl)
augcgccauaunnnagaaatt

SEQ ID NO: 949 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(7): Universal base (Nitropyrrolyl and nitroindolyl)
uucunnnauauggcgcauatt

SEQ ID NO: 950 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(15): Universal base (Nitropyrrolyl and nitroindolyl)
uaugcgccauaunnnagaatt

SEQ ID NO: 951 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(6): Universal base (Nitropyrrolyl and nitroindolyl)
ucunnnauauggcgcauactt

SEQ ID NO: 952 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(16): Universal base (Nitropyrrolyl and nitroindolyl)
guaugcgccauaunnnagatt

SEQ ID NO: 953 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(5): Universal base (Nitropyrrolyl and nitroindolyl)
cunnnauauggcgcauacutt

SEQ ID NO: 954 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(17): Universal base (Nitropyrrolyl and nitroindolyl)
aguaugcgccauaunnnagtt

SEQ ID NO: 955 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(4): Universal base (Nitropyrrolyl and nitroindolyl)
unnnauauggcgcauacuctt

SEQ ID NO: 956 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(18): Universal base (Nitropyrrolyl and nitroindolyl)
gaguaugcgccauaunnnatt

SEQ ID NO: 957 - DNA, 20 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(3): Universal base (Nitropyrrolyl and nitroindolyl)
nnnuauggcgcauacucgtt

SEQ ID NO: 958 - DNA, 20 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(18): Universal base (Nitropyrrolyl and nitroindolyl)
cgaguaugcgccauannntt

SEQ ID NO: 959 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(2): Universal base (Nitropyrrolyl and nitroindolyl)
nnauauggcgcauacucggtt

SEQ ID NO: 960 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(19): Universal base (Nitropyrrolyl and nitroindolyl)
ccgaguaugcgccauaunntt

SEQ ID NO: 961 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nauauggcgcauacucgggtt

SEQ ID NO: 962 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
cccgaguaugcgccauauntt

SEQ ID NO: 963 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
auauggcgcauacucgggctt

SEQ ID NO: 964 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
gcccgaguaugcgccauautt

SEQ ID NO: 965 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
uauggcgcauacucgggcatt

SEQ ID NO: 966 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
ugcccgaguaugcgccauatt

SEQ ID NO: 967 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
auggcgcauacucgggcautt

SEQ ID NO: 968 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
augcccgaguaugcgccautt

SEQ ID NO: 969 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
uggcgcauacucgggcaugtt

SEQ ID NO: 970 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
caugcccgaguaugcgccatt

SEQ ID NO: 971 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
ggcgcauacucgggcaugutt

SEQ ID NO: 972 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
acaugcccgaguaugcgcctt

SEQ ID NO: 973 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(2): Universal base (Nitropyrrolyl and nitroindolyl)
  modified_base (10)..(10): Universal base (Nitropyrrolyl and nitroindolyl)
nnggcccccncaaagccgatt

SEQ ID NO: 974 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
  modified_base (18)..(19): Universal base (Nitropyrrolyl and nitroindolyl)
ucggcuuugngggggccnntt

SEQ ID NO: 975 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
  modified_base (9)..(9): Universal base (Nitropyrrolyl and nitroindolyl)
  modified_base (19)..(19): Universal base (Nitropyrrolyl and nitroindolyl)
nggcccccncaaagccgantt

SEQ ID NO: 976 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
  modified_base (11)..(11): Universal base (Nitropyrrolyl and nitroindolyl)
  modified_base (19)..(19): Universal base (Nitropyrrolyl and nitroindolyl)
nucggcuuugngggggccntt

SEQ ID NO: 977 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
  modified_base (4)..(4): Universal base (Nitropyrrolyl and nitroindolyl)
  modified_base (10)..(10): Universal base (Nitropyrrolyl and nitroindolyl)
nuunacgcunaccgugccctt

SEQ ID NO: 978 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
  modified_base (16)..(16): Universal base (Nitropyrrolyl and nitroindolyl)
  modified_base (19)..(19): Universal base (Nitropyrrolyl and nitroindolyl)
gggcacggunagcgunaantt

SEQ ID NO: 979 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
  modified_base (9)..(9): Universal base (Nitropyrrolyl and nitroindolyl)
uunacgcunaccgugcccatt

SEQ ID NO: 980 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
  modified_base (17)..(17): Universal base (Nitropyrrolyl and nitroindolyl)
ugggcacggunagcgunaatt

SEQ ID NO: 981 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
  modified_base (8)..(8): Universal base (Nitropyrrolyl and nitroindolyl)
unacgcunaccgugcccagtt

SEQ ID NO: 982 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
  modified_base (18)..(18): Universal base (Nitropyrrolyl and nitroindolyl)
cugggcacggunagcgunatt

SEQ ID NO: 983 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
  modified_base (7)..(7): Universal base (Nitropyrrolyl and nitroindolyl)
  modified_base (19)..(19): Universal base (Nitropyrrolyl and nitroindolyl)
nacgcunaccgugcccagntt

SEQ ID NO: 984 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
  modified_base (13)..(13): Universal base (Nitropyrrolyl and nitroindolyl)
  modified_base (19)..(19): Universal base (Nitropyrrolyl and nitroindolyl)
ncugggcacggunagcguntt

SEQ ID NO: 985 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
acguacguucucucuaucntt

SEQ ID NO: 986 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
ngauagagagaacguacgutt

SEQ ID NO: 987 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
cucucuaucnucccgucagtt

SEQ ID NO: 988 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
cugacgggangauagagagtt

SEQ ID NO: 989 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
ucucuaucnucccgucaggtt

SEQ ID NO: 990 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
ccugacgggangauagagatt

SEQ ID NO: 991 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
cucuaucnucccgucaggctt

SEQ ID NO: 992 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
gccugacgggangauagagtt

SEQ ID NO: 993 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(7): Universal base (Nitropyrrolyl and nitroindolyl)
ucuaucnucccgucaggcctt

SEQ ID NO: 994 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(13): Universal base (Nitropyrrolyl and nitroindolyl)
ggccugacgggangauagatt

SEQ ID NO: 995 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
cuaucnucccgucaggccctt

SEQ ID NO: 996 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
gggccugacgggangauagtt

SEQ ID NO: 997 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
uaucnucccgucaggcccctt

SEQ ID NO: 998 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
ggggccugacgggangauatt

SEQ ID NO: 999 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): Universal base (Nitropyrrolyl and nitroindolyl)
aucnucccgucaggccccctt

SEQ ID NO: 1000 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): Universal base (Nitropyrrolyl and nitroindolyl)
gggggccugacgggangautt

SEQ ID NO: 1001 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
ucnucccgucaggcccccutt

SEQ ID NO: 1002 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
agggggccugacgggangatt

SEQ ID NO: 1003 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
cnucccgucaggcccccuctt

SEQ ID NO: 1004 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
gagggggccugacgggangtt

SEQ ID NO: 1005 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nucccgucaggcccccucatt

SEQ ID NO: 1006 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
ugagggggccugacgggantt

SEQ ID NO: 1007 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
aagccgagaucgcgcagantt

SEQ ID NO: 1008 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nucugcgcgaucucggcuutt

SEQ ID NO: 1009 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
gaucungaggcucucauggtt

SEQ ID NO: 1010 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
ccaugagagccucnagauctt

SEQ ID NO: 1011 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
aucungaggcucucauggatt

SEQ ID NO: 1012 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
uccaugagagccucnagautt

SEQ ID NO: 1013 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
ucucaugganuggcuaaagtt

SEQ ID NO: 1014 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
cuuuagccanuccaugagatt

SEQ ID NO: 1015 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
cucaugganuggcuaaagatt

SEQ ID NO: 1016 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
ucuuuagccanuccaugagtt

SEQ ID NO: 1017 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
ucaugganuggcuaaagactt

SEQ ID NO: 1018 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
gucuuuagccanuccaugatt

SEQ ID NO: 1019 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(7): Universal base (Nitropyrrolyl and nitroindolyl)
caugganuggcuaaagacatt

SEQ ID NO: 1020 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(13): Universal base (Nitropyrrolyl and nitroindolyl)
ugucuuuagccanuccaugtt

SEQ ID NO: 1021 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
augganuggcuaaagacaatt

SEQ ID NO: 1022 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
uugucuuuagccanuccautt

SEQ ID NO: 1023 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
ugganuggcuaaagacaagtt

SEQ ID NO: 1024 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
cuugucuuuagccanuccatt

SEQ ID NO: 1025 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): Universal base (Nitropyrrolyl and nitroindolyl)
gganuggcuaaagacaagatt

SEQ ID NO: 1026 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): Universal base (Nitropyrrolyl and nitroindolyl)
ucuugucuuuagccanucctt

SEQ ID NO: 1027 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
ganuggcuaaagacaagactt

SEQ ID NO: 1028 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
gucuugucuuuagccanuctt

SEQ ID NO: 1029 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
anuggcuaaagacaagacctt

SEQ ID NO: 1030 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
ggucuugucuuuagccanutt

SEQ ID NO: 1031 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nuggcuaaagacaagaccatt

SEQ ID NO: 1032 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
uggucuugucuuuagccantt

SEQ ID NO: 1033 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
ccugucaccucugacuaantt

SEQ ID NO: 1034 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nuuagucagaggugacaggtt

SEQ ID NO: 1035 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
uuugunuucacgcucaccgtt

SEQ ID NO: 1036 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
cggugagcgugaanacaaatt

SEQ ID NO: 1037 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
uugunuucacgcucaccgutt

SEQ ID NO: 1038 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
acggugagcgugaanacaatt

SEQ ID NO: 1039 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): Universal base (Nitropyrrolyl and nitroindolyl)
ugunuucacgcucaccgugtt

SEQ ID NO: 1040 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): Universal base (Nitropyrrolyl and nitroindolyl)
cacggugagcgugaanacatt

SEQ ID NO: 1041 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
gunuucacgcucaccgugctt

SEQ ID NO: 1042 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
gcacggugagcgugaanactt

SEQ ID NO: 1043 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
unuucacgcucaccgugcctt

SEQ ID NO: 1044 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
ggcacggugagcgugaanatt

SEQ ID NO: 1045 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nuucacgcucaccgugccctt

SEQ ID NO: 1046 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
gggcacggugagcgugaantt

SEQ ID NO: 1047 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
aggacugcagcguagacgntt

SEQ ID NO: 1048 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
ncgucuacgcugcaguccutt

SEQ ID NO: 1049 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
ugnaugggucucauauacatt

SEQ ID NO: 1050 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
uguauaugagacccauncatt

SEQ ID NO: 1051 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
gnaugggucucauauacaatt

SEQ ID NO: 1052 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
uuguauaugagacccaunctt

SEQ ID NO: 1053 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
naugggucucauauacaactt

SEQ ID NO: 1054 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
guuguauaugagacccauntt

SEQ ID NO: 1055 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
augggucucauauacaacntt

SEQ ID NO: 1056 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nguuguauaugagacccautt

SEQ ID NO: 1057 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
ugugccacnugugagcagatt

SEQ ID NO: 1058 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
ucugcucacanguggcacatt

SEQ ID NO: 1059 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
gugccacnugugagcagautt

SEQ ID NO: 1060 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
aucugcucacanguggcactt

SEQ ID NO: 1061 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
gccacnugugagcagauugtt

SEQ ID NO: 1062 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
caaucugcucacanguggctt

SEQ ID NO: 1063 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
ccacnugugagcagauugctt

SEQ ID NO: 1064 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
gcaaucugcucacanguggtt

SEQ ID NO: 1065 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
cuaggcanauggugcaggctt

SEQ ID NO: 1066 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
gccugcaccaunugccuagtt

SEQ ID NO: 1067 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
augagnacaauugggacuctt

SEQ ID NO: 1068 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
gagucccaauuguncucautt

SEQ ID NO: 1069 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
ugagnacaauugggacucatt

SEQ ID NO: 1070 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
ugagucccaauuguncucatt

SEQ ID NO: 1071 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
uuugcaggcnuaccagaaatt

SEQ ID NO: 1072 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
uuucugguangccugcaaatt

SEQ ID NO: 1073 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
uugcaggcnuaccagaaactt

SEQ ID NO: 1074 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
guuucugguangccugcaatt

SEQ ID NO: 1075 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
ugcaggcnuaccagaaacgtt

SEQ ID NO: 1076 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
cguuucugguangccugcatt

SEQ ID NO: 1077 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
augcagcgnuucaagugautt

SEQ ID NO: 1078 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
aucacuugaancgcugcautt

SEQ ID NO: 1079 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
ugcagcgnuucaagugauctt

SEQ ID NO: 1080 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
gaucacuugaancgcugcatt

SEQ ID NO: 1081 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(7): Universal base (Nitropyrrolyl and nitroindolyl)
gcagcgnuucaagugaucctt

SEQ ID NO: 1082 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(13): Universal base (Nitropyrrolyl and nitroindolyl)
ggaucacuugaancgcugctt

SEQ ID NO: 1083 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
cagcgnuucaagugauccutt

SEQ ID NO: 1084 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
aggaucacuugaancgcugtt

SEQ ID NO: 1085 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
agcgnuucaagugauccuctt

SEQ ID NO: 1086 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
gaggaucacuugaancgcutt

SEQ ID NO: 1087 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): Universal base (Nitropyrrolyl and nitroindolyl)
gcgnuucaagugauccucutt

SEQ ID NO: 1088 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): Universal base (Nitropyrrolyl and nitroindolyl)
agaggaucacuugaancgctt

SEQ ID NO: 1089 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
cauugggaunuugcacuugtt

SEQ ID NO: 1090 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
caagugcaanaucccaaugtt

SEQ ID NO: 1091 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
auugggaunuugcacuugatt

SEQ ID NO: 1092 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
ucaagugcaanaucccaautt

SEQ ID NO: 1093 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
uugggaunuugcacuugautt

SEQ ID NO: 1094 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
aucaagugcaanaucccaatt

SEQ ID NO: 1095 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(7): Universal base (Nitropyrrolyl and nitroindolyl)
ugggaunuugcacuugauatt

SEQ ID NO: 1096 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(13): Universal base (Nitropyrrolyl and nitroindolyl)
uaucaagugcaanaucccatt

SEQ ID NO: 1097 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
gggaunuugcacuugauautt

SEQ ID NO: 1098 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
auaucaagugcaanauccctt

SEQ ID NO: 1099 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
ggaunuugcacuugauauutt

SEQ ID NO: 1100 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
aauaucaagugcaanaucctt

SEQ ID NO: 1101 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): Universal base (Nitropyrrolyl and nitroindolyl)
gaunuugcacuugauauugtt

SEQ ID NO: 1102 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): Universal base (Nitropyrrolyl and nitroindolyl)
caauaucaagugcaanauctt

SEQ ID NO: 1103 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
aunuugcacuugauauugutt

SEQ ID NO: 1104 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
acaauaucaagugcaanautt

SEQ ID NO: 1105 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
unuugcacuugauauugugtt

SEQ ID NO: 1106 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
cacaauaucaagugcaanatt

SEQ ID NO: 1107 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nuugcacuugauauuguggtt

SEQ ID NO: 1108 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
ccacaauaucaagugcaantt

SEQ ID NO: 1109 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
aaaugcauuuaucgucgcntt

SEQ ID NO: 1110 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
ngcgacgauaaaugcauuutt

SEQ ID NO: 1111 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
uaucgucgcnuuaaauacgtt

SEQ ID NO: 1112 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
cguauuuaangcgacgauatt

SEQ ID NO: 1113 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
aucgucgcnuuaaauacggtt

SEQ ID NO: 1114 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
ccguauuuaangcgacgautt

SEQ ID NO: 1115 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
ucgucgcnuuaaauacggutt

SEQ ID NO: 1116 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
accguauuuaangcgacgatt

SEQ ID NO: 1117 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(7): Universal base (Nitropyrrolyl and nitroindolyl)
cgucgcnuuaaauacgguutt

SEQ ID NO: 1118 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(13): Universal base (Nitropyrrolyl and nitroindolyl)
aaccguauuuaangcgacgtt

SEQ ID NO: 1119 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
gucgcnuuaaauacgguuutt

SEQ ID NO: 1120 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
aaaccguauuuaangcgactt

SEQ ID NO: 1121 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
ucgcnuuaaauacgguuugtt

SEQ ID NO: 1122 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
caaaccguauuuaangcgatt

SEQ ID NO: 1123 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): Universal base (Nitropyrrolyl and nitroindolyl)
cgcnuuaaauacgguuugatt

SEQ ID NO: 1124 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): Universal base (Nitropyrrolyl and nitroindolyl)
ucaaaccguauuuaangcgtt

SEQ ID NO: 1125 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
gcnuuaaauacgguuugaatt

SEQ ID NO: 1126 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
uucaaaccguauuuaangctt

SEQ ID NO: 1127 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
cnuuaaauacgguuugaaatt

SEQ ID NO: 1128 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
uuucaaaccguauuuaangtt

SEQ ID NO: 1129 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nuuaaauacgguuugaaaatt

SEQ ID NO: 1130 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
uuuucaaaccguauuuaantt

SEQ ID NO: 1131 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
gguuugaaaagagggccuntt

SEQ ID NO: 1132 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
naggcccucuuuucaaacctt

SEQ ID NO: 1133 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nuugaaaagagggccuucutt

SEQ ID NO: 1134 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
agaaggcccucuuuucaantt

SEQ ID NO: 1135 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
aaaanagggccuucuacggtt

SEQ ID NO: 1136 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
ccguagaaggcccunuuuutt

SEQ ID NO: 1137 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
aaagagggccuucuacggntt

SEQ ID NO: 1138 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nccguagaaggcccucuuutt

SEQ ID NO: 1139 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
gunccugagucuaugagggtt

SEQ ID NO: 1140 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
cccucauagacucaggnactt

SEQ ID NO: 1141 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
unccugagucuaugagggatt

SEQ ID NO: 1142 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
ucccucauagacucaggnatt

SEQ ID NO: 1143 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nccugagucuaugagggaatt

SEQ ID NO: 1144 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
uucccucauagacucaggntt

SEQ ID NO: 1145 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
ugagucuaugagggaagantt

SEQ ID NO: 1146 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nucuucccucauagacucatt

SEQ ID NO: 1147 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
caganugcuguggauguugtt

SEQ ID NO: 1148 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
caacauccacagcanucugtt

SEQ ID NO: 1149 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): Universal base (Nitropyrrolyl and nitroindolyl)
aganugcuguggauguugatt

SEQ ID NO: 1150 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): Universal base (Nitropyrrolyl and nitroindolyl)
ucaacauccacagcanucutt

SEQ ID NO: 1151 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
ganugcuguggauguugactt

SEQ ID NO: 1152 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
gucaacauccacagcanuctt

SEQ ID NO: 1153 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
anugcuguggauguugacgtt

SEQ ID NO: 1154 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
cgucaacauccacagcanutt

SEQ ID NO: 1155 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nugcuguggauguugacgatt

SEQ ID NO: 1156 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
ucgucaacauccacagcantt

SEQ ID NO: 1157 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nucaaggcaccaaacgauctt

SEQ ID NO: 1158 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
gaucguuuggugccuugantt

SEQ ID NO: 1159 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
aggcaccaaacgaucuuantt

SEQ ID NO: 1160 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nuaagaucguuuggugccutt

SEQ ID NO: 1161 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
uaugancagauggaaacugtt

SEQ ID NO: 1162 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
caguuuccaucugnucauatt

SEQ ID NO: 1163 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
augancagauggaaacuggtt

SEQ ID NO: 1164 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
ccaguuuccaucugnucautt

SEQ ID NO: 1165 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): Universal base (Nitropyrrolyl and nitroindolyl)
ugancagauggaaacuggutt

SEQ ID NO: 1166 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): Universal base (Nitropyrrolyl and nitroindolyl)
accaguuuccaucugnucatt

SEQ ID NO: 1167 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
gancagauggaaacuggugtt

SEQ ID NO: 1168 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
caccaguuuccaucugnuctt

SEQ ID NO: 1169 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
ancagauggaaacugguggtt

SEQ ID NO: 1170 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
ccaccaguuuccaucugnutt

SEQ ID NO: 1171 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
aacugguggngaacgccagtt

SEQ ID NO: 1172 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
cuggcguucnccaccaguutt

SEQ ID NO: 1173 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
acugguggngaacgccagatt

SEQ ID NO: 1174 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
ucuggcguucnccaccagutt

SEQ ID NO: 1175 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
cugguggngaacgccagaatt

SEQ ID NO: 1176 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
uucuggcguucnccaccagtt

SEQ ID NO: 1177 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(7): Universal base (Nitropyrrolyl and nitroindolyl)
ugguggngaacgccagaautt

SEQ ID NO: 1178 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(13): Universal base (Nitropyrrolyl and nitroindolyl)
auucuggcguucnccaccatt

SEQ ID NO: 1179 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
gguggngaacgccagaaugtt

SEQ ID NO: 1180 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
cauucuggcguucnccacctt

SEQ ID NO: 1181 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
guggngaacgccagaaugctt

SEQ ID NO: 1182 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
gcauucuggcguucnccactt

SEQ ID NO: 1183 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
ccagaaugcnacugagauctt

SEQ ID NO: 1184 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
gaucucagungcauucuggtt

SEQ ID NO: 1185 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
cagaaugcnacugagaucatt

SEQ ID NO: 1186 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
ugaucucagungcauucugtt

SEQ ID NO: 1187 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
agaaugcnacugagaucagtt

SEQ ID NO: 1188 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
cugaucucagungcauucutt

SEQ ID NO: 1189 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
gaugugcacngaacucaaatt

SEQ ID NO: 1190 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
uuugaguucngugcacauctt

SEQ ID NO: 1191 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
augugcacngaacucaaactt

SEQ ID NO: 1192 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
guuugaguucngugcacautt

SEQ ID NO: 1193 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
ugugcacngaacucaaacutt

SEQ ID NO: 1194 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
aguuugaguucngugcacatt

SEQ ID NO: 1195 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(7): Universal base (Nitropyrrolyl and nitroindolyl)
gugcacngaacucaaacuctt

SEQ ID NO: 1196 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(13): Universal base (Nitropyrrolyl and nitroindolyl)
gaguuugaguucngugcactt

SEQ ID NO: 1197 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
ugcacngaacucaaacucatt

SEQ ID NO: 1198 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
ugaguuugaguucngugcatt

SEQ ID NO: 1199 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
gcacngaacucaaacucagtt

SEQ ID NO: 1200 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
cugaguuugaguucngugctt

SEQ ID NO: 1201 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
canaacagcauaacaauagtt

SEQ ID NO: 1202 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
cuauuguuaugcuguunugtt

SEQ ID NO: 1203 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
anaacagcauaacaauagatt

SEQ ID NO: 1204 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
ucuauuguuaugcuguunutt

SEQ ID NO: 1205 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
naacagcauaacaauagagtt

SEQ ID NO: 1206 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
cucuauuguuaugcuguuntt

SEQ ID NO: 1207 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
aacaauagagagaaugguntt

SEQ ID NO: 1208 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
naccauucucucuauuguutt

SEQ ID NO: 1209 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
ugaugaunuggcauuccaatt

SEQ ID NO: 1210 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
uuggaaugccanaucaucatt

SEQ ID NO: 1211 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
augugnucucugaugcaagtt

SEQ ID NO: 1212 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
cuugcaucagagancacautt

SEQ ID NO: 1213 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
ugugnucucugaugcaaggtt

SEQ ID NO: 1214 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
ccuugcaucagagancacatt

SEQ ID NO: 1215 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
agnauugcauaugagagaatt

SEQ ID NO: 1216 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
uucucucauaugcaauncutt

SEQ ID NO: 1217 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
gnauugcauaugagagaautt

SEQ ID NO: 1218 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
auucucucauaugcaaunctt

SEQ ID NO: 1219 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nauugcauaugagagaaugtt

SEQ ID NO: 1220 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
cauucucucauaugcaauntt

SEQ ID NO: 1221 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): Universal base (Nitropyrrolyl and nitroindolyl)
ugcnuaugagagaaugugctt

SEQ ID NO: 1222 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): Universal base (Nitropyrrolyl and nitroindolyl)
gcacauucucucauangcatt

SEQ ID NO: 1223 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
auaugagagaaugugcaantt

SEQ ID NO: 1224 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nuugcacauucucucauautt

SEQ ID NO: 1225 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
uauganagaaugugcaacatt

SEQ ID NO: 1226 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
uguugcacauucunucauatt

SEQ ID NO: 1227 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
auganagaaugugcaacautt

SEQ ID NO: 1228 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
auguugcacauucunucautt

SEQ ID NO: 1229 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
aaugugcaanauccucaaatt

SEQ ID NO: 1230 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
uuugaggaunuugcacauutt

SEQ ID NO: 1231 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
augugcaanauccucaaagtt

SEQ ID NO: 1232 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
cuuugaggaunuugcacautt

SEQ ID NO: 1233 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
ugugcaanauccucaaaggtt

SEQ ID NO: 1234 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
ccuuugaggaunuugcacatt

SEQ ID NO: 1235 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
agggaaauuncaaacagcatt

SEQ ID NO: 1236 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
ugcuguuugnaauuucccutt

SEQ ID NO: 1237 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
gggaaauuncaaacagcagtt

SEQ ID NO: 1238 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
cugcuguuugnaauuuccctt

SEQ ID NO: 1239 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
ggaaauuncaaacagcagctt

SEQ ID NO: 1240 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
gcugcuguuugnaauuucctt

SEQ ID NO: 1241 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(7): Universal base (Nitropyrrolyl and nitroindolyl)
gaaauuncaaacagcagcatt

SEQ ID NO: 1242 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(13): Universal base (Nitropyrrolyl and nitroindolyl)
ugcugcuguuugnaauuuctt

SEQ ID NO: 1243 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
aaauuncaaacagcagcactt

SEQ ID NO: 1244 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
gugcugcuguuugnaauuutt

SEQ ID NO: 1245 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
aauuncaaacagcagcacatt

SEQ ID NO: 1246 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
ugugcugcuguuugnaauutt

SEQ ID NO: 1247 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): Universal base (Nitropyrrolyl and nitroindolyl)
auuncaaacagcagcacaatt

SEQ ID NO: 1248 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): Universal base (Nitropyrrolyl and nitroindolyl)
uugugcugcuguuugnaautt

SEQ ID NO: 1249 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(7): Universal base (Nitropyrrolyl and nitroindolyl)
gcacaangagcaaugauggtt

SEQ ID NO: 1250 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(13): Universal base (Nitropyrrolyl and nitroindolyl)
ccaucauugcucnuugugctt

SEQ ID NO: 1251 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
cacaangagcaaugauggatt

SEQ ID NO: 1252 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
uccaucauugcucnuugugtt

SEQ ID NO: 1253 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
acauucccnuauacuggagtt

SEQ ID NO: 1254 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
cuccaguauangggaaugutt

SEQ ID NO: 1255 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
cauucccnuauacuggagatt

SEQ ID NO: 1256 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
ucuccaguauangggaaugtt

SEQ ID NO: 1257 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
ggaganccuccauacagcctt

SEQ ID NO: 1258 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
ggcuguauggaggnucucctt

SEQ ID NO: 1259 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
gaganccuccauacagccatt

SEQ ID NO: 1260 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
uggcuguauggaggnucuctt

SEQ ID NO: 1261 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): Universal base (Nitropyrrolyl and nitroindolyl)
aganccuccauacagccautt

SEQ ID NO: 1262 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): Universal base (Nitropyrrolyl and nitroindolyl)
auggcuguauggaggnucutt

SEQ ID NO: 1263 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
ganccuccauacagccaugtt

SEQ ID NO: 1264 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
cauggcuguauggaggnuctt

SEQ ID NO: 1265 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
ccnccauacagccauggaatt

SEQ ID NO: 1266 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
uuccauggcuguauggnggtt

SEQ ID NO: 1267 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
cnccauacagccauggaactt

SEQ ID NO: 1268 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
guuccauggcuguauggngtt

SEQ ID NO: 1269 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nccauacagccauggaacatt

SEQ ID NO: 1270 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
uguuccauggcuguauggntt

SEQ ID NO: 1271 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
auacagccauggaacaggntt

SEQ ID NO: 1272 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nccuguuccauggcuguautt

SEQ ID NO: 1273 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
uggaacaggnacaggauactt

SEQ ID NO: 1274 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
guauccugunccuguuccatt

SEQ ID NO: 1275 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
ggaacaggnacaggauacatt

SEQ ID NO: 1276 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
uguauccugunccuguucctt

SEQ ID NO: 1277 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
gaacaggnacaggauacactt

SEQ ID NO: 1278 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
guguauccugunccuguuctt

SEQ ID NO: 1279 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(7): Universal base (Nitropyrrolyl and nitroindolyl)
aacaggnacaggauacacctt

SEQ ID NO: 1280 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(13): Universal base (Nitropyrrolyl and nitroindolyl)
gguguauccugunccuguutt

SEQ ID NO: 1281 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
acaggnacaggauacaccatt

SEQ ID NO: 1282 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
ugguguauccugunccugutt

SEQ ID NO: 1283 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
caggnacaggauacaccautt

SEQ ID NO: 1284 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
augguguauccugunccugtt

SEQ ID NO: 1285 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): Universal base (Nitropyrrolyl and nitroindolyl)
aggnacaggauacaccaugtt

SEQ ID NO: 1286 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): Universal base (Nitropyrrolyl and nitroindolyl)
caugguguauccugunccutt

SEQ ID NO: 1287 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
ggnacaggauacaccauggtt

SEQ ID NO: 1288 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
ccaugguguauccuguncctt

SEQ ID NO: 1289 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
gnacaggauacaccauggatt

SEQ ID NO: 1290 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
uccaugguguauccugunctt

SEQ ID NO: 1291 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nacaggauacaccauggactt

SEQ ID NO: 1292 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
guccaugguguauccuguntt

SEQ ID NO: 1293 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
aggauacaccauggacacntt

SEQ ID NO: 1294 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nguguccaugguguauccutt

SEQ ID NO: 1295 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
acacngucaacagaacacatt

SEQ ID NO: 1296 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
uguguucuguugacngugutt

SEQ ID NO: 1297 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
gunuuggaagcaauggcuutt

SEQ ID NO: 1298 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
aagccauugcuuccaanactt

SEQ ID NO: 1299 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
unuuggaagcaauggcuuutt

SEQ ID NO: 1300 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
aaagccauugcuuccaanatt

SEQ ID NO: 1301 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nuuggaagcaauggcuuuctt

SEQ ID NO: 1302 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
gaaagccauugcuuccaantt

SEQ ID NO: 1303 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
gcaauggcuuuccuugaantt

SEQ ID NO: 1304 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nuucaaggaaagccauugctt

SEQ ID NO: 1305 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
caauggcnuuccuugaagatt

SEQ ID NO: 1306 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
ucuucaaggaangccauugtt

SEQ ID NO: 1307 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
ugaaaacucnugucuugaatt

SEQ ID NO: 1308 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
uucaagacangaguuuucatt

SEQ ID NO: 1309 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
gaaaacucnugucuugaaatt

SEQ ID NO: 1310 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
uuucaagacangaguuuuctt

SEQ ID NO: 1311 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
aaaacucnugucuugaaactt

SEQ ID NO: 1312 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
guuucaagacangaguuuutt

SEQ ID NO: 1313 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
cgccagacnuaugacuggatt

SEQ ID NO: 1314 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
uccagucauangucuggcgtt

SEQ ID NO: 1315 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
gccagacnuaugacuggactt

SEQ ID NO: 1316 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
guccagucauangucuggctt

SEQ ID NO: 1317 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(7): Universal base (Nitropyrrolyl and nitroindolyl)
ccagacnuaugacuggacatt

SEQ ID NO: 1318 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(13): Universal base (Nitropyrrolyl and nitroindolyl)
uguccagucauangucuggtt

SEQ ID NO: 1319 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
caugaccaanaaaaugguctt

SEQ ID NO: 1320 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
gaccauuuunuuggucaugtt

SEQ ID NO: 1321 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
augaccaanaaaauggucatt

SEQ ID NO: 1322 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
ugaccauuuunuuggucautt

SEQ ID NO: 1323 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
ugaccaanaaaauggucactt

SEQ ID NO: 1324 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
gugaccauuuunuuggucatt

SEQ ID NO: 1325 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(7): Universal base (Nitropyrrolyl and nitroindolyl)
gaccaanaaaauggucacatt

SEQ ID NO: 1326 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(13): Universal base (Nitropyrrolyl and nitroindolyl)
ugugaccauuuunuugguctt

SEQ ID NO: 1327 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
accaanaaaauggucacactt

SEQ ID NO: 1328 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
gugugaccauuuunuuggutt

SEQ ID NO: 1329 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
ccaanaaaauggucacacatt

SEQ ID NO: 1330 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
ugugugaccauuuunuuggtt

SEQ ID NO: 1331 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): Universal base (Nitropyrrolyl and nitroindolyl)
caanaaaauggucacacaatt

SEQ ID NO: 1332 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): Universal base (Nitropyrrolyl and nitroindolyl)
uugugugaccauuuunuugtt

SEQ ID NO: 1333 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
anaaaauggucacacaaagtt

SEQ ID NO: 1334 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
cuuugugugaccauuuunutt

SEQ ID NO: 1335 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
ugacanugaacacaaugactt

SEQ ID NO: 1336 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
gucauuguguucanugucatt

SEQ ID NO: 1337 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
aanaugaugacuaacucactt

SEQ ID NO: 1338 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
gugaguuagucaucaunuutt

SEQ ID NO: 1339 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
anaugaugacuaacucacatt

SEQ ID NO: 1340 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
ugugaguuagucaucaunutt

SEQ ID NO: 1341 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
naugaugacuaacucacaatt

SEQ ID NO: 1342 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
uugugaguuagucaucauntt

SEQ ID NO: 1343 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
gaugacuaacucacaagantt

SEQ ID NO: 1344 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nucuugugaguuagucauctt

SEQ ID NO: 1345 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
gacaanaccaaauggaaugtt

SEQ ID NO: 1346 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
cauuccauuuggunuuguctt

SEQ ID NO: 1347 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
acaanaccaaauggaaugatt

SEQ ID NO: 1348 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
ucauuccauuuggunuugutt

SEQ ID NO: 1349 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): Universal base (Nitropyrrolyl and nitroindolyl)
caanaccaaauggaaugagtt

SEQ ID NO: 1350 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): Universal base (Nitropyrrolyl and nitroindolyl)
cucauuccauuuggunuugtt

SEQ ID NO: 1351 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
aanaccaaauggaaugagatt

SEQ ID NO: 1352 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
ucucauuccauuuggunuutt

SEQ ID NO: 1353 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
anaccaaauggaaugagaatt

SEQ ID NO: 1354 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
uucucauuccauuuggunutt

SEQ ID NO: 1355 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
naccaaauggaaugagaautt

SEQ ID NO: 1356 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
auucucauuccauuugguntt

SEQ ID NO: 1357 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (19)..(19): Universal base (Nitropyrrolyl and nitroindolyl)
caaauggaaugagaaucantt

SEQ ID NO: 1358 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): Universal base (Nitropyrrolyl and nitroindolyl)
nugauucucauuccauuugtt

SEQ ID NO: 1359 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
auugcnccuauaauguucutt

SEQ ID NO: 1360 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
agaacauuauaggngcaautt

SEQ ID NO: 1361 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
uugcnccuauaauguucuctt

SEQ ID NO: 1362 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
gagaacauuauaggngcaatt

SEQ ID NO: 1363 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
gcnccuauaauguucucaatt

SEQ ID NO: 1364 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
uugagaacauuauaggngctt

SEQ ID NO: 1365 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
cnccuauaauguucucaaatt

SEQ ID NO: 1366 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
uuugagaacauuauaggngtt

SEQ ID NO: 1367 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
uacgnacacaaauaccagctt

SEQ ID NO: 1368 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
gcugguauuuguguncguatt

SEQ ID NO: 1369 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): Universal base (Nitropyrrolyl and nitroindolyl)
cgnacacaaauaccagcagtt

SEQ ID NO: 1370 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): Universal base (Nitropyrrolyl and nitroindolyl)
cugcugguauuuguguncgtt

SEQ ID NO: 1371 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): Universal base (Nitropyrrolyl and nitroindolyl)
gnacacaaauaccagcagatt

SEQ ID NO: 1372 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): Universal base (Nitropyrrolyl and nitroindolyl)
ucugcugguauuugugunctt

SEQ ID NO: 1373 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
acacanauaccagcagaaatt

SEQ ID NO: 1374 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
uuucugcugguaunugugutt

SEQ ID NO: 1375 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): Universal base (Nitropyrrolyl and nitroindolyl)
cacanauaccagcagaaautt

SEQ ID NO: 1376 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): Universal base (Nitropyrrolyl and nitroindolyl)
auuucugcugguaunugugtt

SEQ ID NO: 1377 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
acaaauaccngcagaaaugtt

SEQ ID NO: 1378 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
cauuucugcngguauuugutt

SEQ ID NO: 1379 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
caaauaccngcagaaaugctt

SEQ ID NO: 1380 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
gcauuucugcngguauuugtt

SEQ ID NO: 1381 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
aaauaccngcagaaaugcutt

SEQ ID NO: 1382 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
agcauuucugcngguauuutt

SEQ ID NO: 1383 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
aauaccagcngaaaugcuutt

SEQ ID NO: 1384 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (10)..(10): Universal base (Nitropyrrolyl and nitroindolyl)
aagcauuucngcugguauutt

SEQ ID NO: 1385 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (9)..(9): Universal base (Nitropyrrolyl and nitroindolyl)
auaccagcngaaaugcuugtt

SEQ ID NO: 1386 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): Universal base (Nitropyrrolyl and nitroindolyl)
caagcauuucngcugguautt

SEQ ID NO: 1387 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
uaccagcngaaaugcuugctt

SEQ ID NO: 1388 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
gcaagcauuucngcugguatt

SEQ ID NO: 1389 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (7)..(7): Universal base (Nitropyrrolyl and nitroindolyl)
accagcngaaaugcuugcatt

SEQ ID NO: 1390 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(13): Universal base (Nitropyrrolyl and nitroindolyl)
ugcaagcauuucngcuggutt

SEQ ID NO: 1391 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (6)..(6): Universal base (Nitropyrrolyl and nitroindolyl)
ccagcngaaaugcuugcaatt

SEQ ID NO: 1392 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): Universal base (Nitropyrrolyl and nitroindolyl)
uugcaagcauuucngcuggtt

SEQ ID NO: 1393 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): Universal base (Nitropyrrolyl and nitroindolyl)
agaaaaungagaaaauaagtt

SEQ ID NO: 1394 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): Universal base (Nitropyrrolyl and nitroindolyl)
cuuauuuucucnauuuucutt

SEQ ID NO: 1395 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methylcytidine-5'-phosphate
  modified_base (2)..(3): 2'-O-methyluridine-5'-phosphate
  modified_base (4)..(4): 2'-O-methylcytidine-5'-phosphate
  modified_base (8)..(8): 2'-O-methyluridine-5'-phosphate
  modified_base (9)..(9): 2'-O-methylcytidine-5'-phosphate
  modified_base (13)..(13): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (18)..(18): 2'-O-methyluridine-5'-phosphate
  modified_base (21)..(21): thymidine 5'-phosphorothioate
cuucagaucgaacggucuatn

SEQ ID NO: 1396 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methyluridine-5'-phosphate
  modified_base (21)..(21): thymidine 5'-phosphorothioate
uagaccguucgaucugaagtn

SEQ ID NO: 1397 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methylcytidine-5'-phosphate
  modified_base (5)..(5): 2'-O-methyluridine-5'-phosphate
  modified_base (6)..(6): 2'-O-methylcytidine-5'-phosphate
  modified_base (10)..(10): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (15)..(15): 2'-O-methyluridine-5'-phosphate
  modified_base (18)..(18): 2'-O-methylcytidine-5'-phosphate
  modified_base (21)..(21): thymidine 5'-phosphorothioate
cagaucgaacggucuaacatn

SEQ ID NO: 1398 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): 2'-O-methyluridine-5'-phosphate
  modified_base (21)..(21): thymidine 5'-phosphorothioate
uguuagaccguucgaucugtn

SEQ ID NO: 1399 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): 2'-O-methyluridine-5'-phosphate
  modified_base (5)..(5): 2'-O-methylcytidine-5'-phosphate
  modified_base (9)..(9): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (14)..(14): 2'-O-methyluridine-5'-phosphate
  modified_base (17)..(17): 2'-O-methylcytidine-5'-phosphate
  modified_base (21)..(21): thymidine 5'-phosphorothioate
agaucgaacggucuaacagtn

SEQ ID NO: 1400 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): 2'-O-methyluridine-5'-phosphate
  modified_base (21)..(21): thymidine 5'-phosphorothioate
cuguuagaccguucgaucutn

SEQ ID NO: 1401 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methylcytidine-5'-phosphate
  modified_base (4)..(4): 2'-O-methyluridine-5'-phosphate
  modified_base (6)..(6): 2'-O-methyluridine-5'-phosphate
  modified_base (8)..(8): 2'-O-methylcytidine-5'-phosphate
  modified_base (9)..(9): 2'-O-methyluridine-5'-phosphate
  modified_base (15)..(15): 2'-O-methyluridine-5'-phosphate
  modified_base (17)..(17): 2'-O-methylcytidine-5'-phosphate
  modified_base (18)..(18): 2'-O-methylcytidine-5'-phosphate
  modified_base (21)..(21): thymidine 5'-phosphorothioate
caaaaugcuauaaguaccatn

SEQ ID NO: 1402 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): 2'-O-methyluridine-5'-phosphate
  modified_base (8)..(8): 2'-O-methyluridine-5'-phosphate
  modified_base (10)..(10): 2'-O-methyluridine-5'-phosphate
  modified_base (13)..(13): 2'-O-methylcytidine-5'-phosphate
  modified_base (21)..(21): thymidine 5'-phosphorothioate
ugguacuuauagcauuuugtn

SEQ ID NO: 1403 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(2): 2'-O-methyluridine-5'-phosphate
  modified_base (3)..(3): 2'-O-methylcytidine-5'-phosphate
  modified_base (7)..(7): 2'-O-methyluridine-5'-phosphate
  modified_base (8)..(8): 2'-O-methylcytidine-5'-phosphate
  modified_base (12)..(12): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (17)..(17): 2'-O-methyluridine-5'-phosphate
  modified_base (21)..(21): thymidine 5'-phosphorothioate
uucagaucgaacggucuaatn

SEQ ID NO: 1404 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methyluridine-5'-phosphate
  modified_base (21)..(21): thymidine 5'-phosphorothioate
uuagaccguucgaucugaatn

SEQ ID NO: 1405 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methyluridine-5'-phosphate
  modified_base (3)..(4): 2'-O-methylcytidine-5'-phosphate
  modified_base (6)..(6): 2'-O-methylcytidine-5'-phosphate
  modified_base (8)..(9): 2'-O-methyluridine-5'-phosphate
  modified_base (10)..(12): 2'-O-methylcytidine-5'-phosphate
  modified_base (13)..(14): 2'-O-methyluridine-5'-phosphate
  modified_base (16)..(16): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): thymidine 5'-phosphorothioate
uaccacauucccuuauacutn

SEQ ID NO: 1406 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): 2'-O-methyluridine-5'-phosphate
  modified_base (5)..(5): 2'-O-methyluridine-5'-phosphate
  modified_base (18)..(18): 2'-O-methyluridine-5'-phosphate
  modified_base (21)..(21): thymidine 5'-phosphorothioate
aguauaagggaaugugguatn

SEQ ID NO: 1407 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(3): 2'-O-methyluridine-5'-phosphate
  modified_base (16)..(16): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): thymidine 5'-phosphorothioate
uuugagagagaaggguacutn

SEQ ID NO: 1408 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): 2'-O-methyluridine-5'-phosphate
  modified_base (16)..(16): 2'-O-methylcytidine-5'-phosphate
  modified_base (21)..(21): thymidine 5'-phosphorothioate
aguacccuucucucucaaatn

SEQ ID NO: 1409 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): 2'-O-methylcytidine-5'-phosphate
  modified_base (7)..(7): 2'-O-methylcytidine-5'-phosphate
  modified_base (11)..(13): 2'-O-methylcytidine-5'-phosphate
  modified_base (16)..(16): 2'-O-methyluridine-5'-phosphate
  modified_base (17)..(17): 2'-O-methylcytidine-5'-phosphate
  modified_base (19)..(19): 2'-O-methyluridine-5'-phosphate
  modified_base (21)..(21): thymidine 5'-phosphorothioate
aggcaacgaacccgaucgutn

SEQ ID NO: 1410 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): 2'-O-methyluridine-5'-phosphate
  modified_base (21)..(21): thymidine 5'-phosphorothioate
acgaucggguucguugccutn

SEQ ID NO: 1411 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): 2'-O-methylcytidine-5'-phosphate
  modified_base (6)..(6): 2'-O-methylcytidine-5'-phosphate
  modified_base (10)..(12): 2'-O-methylcytidine-5'-phosphate
  modified_base (15)..(15): 2'-O-methyluridine-5'-phosphate
  modified_base (16)..(16): 2'-O-methylcytidine-5'-phosphate
  modified_base (18)..(18): 2'-O-methyluridine-5'-phosphate
  modified_base (21)..(21): thymidine 5'-phosphorothioate
ggcaacgaacccgaucgugtn

SEQ ID NO: 1412 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methylcytidine-5'-phosphate
  modified_base (21)..(21): thymidine 5'-phosphorothioate
cacgaucggguucguugcctn

SEQ ID NO: 1413 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methylcytidine-5'-phosphate
  modified_base (4)..(4): 2'-O-methylcytidine-5'-phosphate
  modified_base (8)..(10): 2'-O-methylcytidine-5'-phosphate
  modified_base (13)..(13): 2'-O-methyluridine-5'-phosphate
  modified_base (14)..(14): 2'-O-methylcytidine-5'-phosphate
  modified_base (16)..(16): 2'-O-methyluridine-5'-phosphate
  modified_base (18)..(19): 2'-O-methylcytidine-5'-phosphate
  modified_base (21)..(21): thymidine 5'-phosphorothioate
caacgaacccgaucgugcctn

SEQ ID NO: 1414 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): 2'-O-methylcytidine-5'-phosphate
  modified_base (21)..(21): thymidine 5'-phosphorothioate
ggcacgaucggguucguugtn

SEQ ID NO: 1415 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methylcytidine-5'-phosphate
  modified_base (5)..(5): 2'-O-methylcytidine-5'-phosphate
  modified_base (9)..(11): 2'-O-methylcytidine-5'-phosphate
  modified_base (14)..(14): 2'-O-methyluridine-5'-phosphate
  modified_base (15)..(15): 2'-O-methylcytidine-5'-phosphate
  modified_base (17)..(17): 2'-O-methyluridine-5'-phosphate
  modified_base (19)..(19): 2'-O-methylcytidine-5'-phosphate
  modified_base (21)..(21): thymidine 5'-phosphorothioate
gcaacgaacccgaucgugctn

SEQ ID NO: 1416 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methylcytidine-5'-phosphate
  modified_base (21)..(21): thymidine 5'-phosphorothioate
gcacgaucggguucguugctn

SEQ ID NO: 1417 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (8)..(8): 2'-O-methylcytidine-5'-phosphate
  modified_base (11)..(11): 2'-O-methylcytidine-5'-phosphate
  modified_base (15)..(17): 2'-O-methylcytidine-5'-phosphate
  modified_base (21)..(21): thymidine 5'-phosphorothioate
gaaaaggcaacgaacccgatn

SEQ ID NO: 1418 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): 2'-O-methyluridine-5'-phosphate
  modified_base (21)..(21): thymidine 5'-phosphorothioate
ucggguucguugccuuuuctn

SEQ ID NO: 1419 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methyluridine-5'-phosphate
  modified_base (3)..(3): 2'-O-methylcytidine-5'-phosphate
  modified_base (5)..(5): 2'-O-methyluridine-5'-phosphate
  modified_base (8)..(8): 2'-O-methyluridine-5'-phosphate
  modified_base (14)..(14): 2'-O-methylcytidine-5'-phosphate
  modified_base (17)..(17): 2'-O-methyluridine-5'-phosphate
  modified_base (18)..(19): 2'-O-methylcytidine-5'-phosphate
  modified_base (21)..(21): thymidine 5'-phosphorothioate
ugcaugauaaaggcagucctn

SEQ ID NO: 1420 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): 2'-O-methyluridine-5'-phosphate
  modified_base (14)..(14): 2'-O-methylcytidine-5'-phosphate
  modified_base (18)..(18): 2'-O-methylcytidine-5'-phosphate
  modified_base (21)..(21): thymidine 5'-phosphorothioate
ggacugccuuuaucaugcatn

SEQ ID NO: 1421 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methyluridine-5'-phosphate
  modified_base (8)..(8): 2'-O-methyluridine-5'-phosphate
  modified_base (11)..(11): 2'-O-methyluridine-5'-phosphate
  modified_base (12)..(12): 2'-O-methylcytidine-5'-phosphate
  modified_base (17)..(17): 2'-O-methyluridine-5'-phosphate
  modified_base (19)..(19): 2'-O-methyluridine-5'-phosphate
  modified_base (21)..(21): thymidine 5'-phosphorothioate
auggggaugaucggaauautn

SEQ ID NO: 1422 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methyluridine-5'-phosphate
  modified_base (11)..(11): 2'-O-methylcytidine-5'-phosphate
  modified_base (17)..(17): 2'-O-methylcytidine-5'-phosphate
  modified_base (21)..(21): thymidine 5'-phosphorothioate
auauuccgaucauccccautn

SEQ ID NO: 1423 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methyluridine-5'-phosphate
  modified_base (7)..(7): 2'-O-methyluridine-5'-phosphate
  modified_base (10)..(10): 2'-O-methyluridine-5'-phosphate
  modified_base (11)..(11): 2'-O-methylcytidine-5'-phosphate
  modified_base (16)..(16): 2'-O-methyluridine-5'-phosphate
  modified_base (18)..(19): 2'-O-methyluridine-5'-phosphate
  modified_base (21)..(21): thymidine 5'-phosphorothioate
uggggaugaucggaauauutn

SEQ ID NO: 1424 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): 2'-O-methyluridine-5'-phosphate
  modified_base (12)..(12): 2'-O-methylcytidine-5'-phosphate
  modified_base (18)..(18): 2'-O-methylcytidine-5'-phosphate
  modified_base (21)..(21): thymidine 5'-phosphorothioate
aauauuccgaucauccccatn

SEQ ID NO: 1425 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (5)..(5): 2'-O-methylcytidine-5'-phosphate
  modified_base (10)..(10): 2'-O-methylcytidine-5'-phosphate
  modified_base (11)..(11): 2'-O-methyluridine-5'-phosphate
  modified_base (12)..(12): 2'-O-methylcytidine-5'-phosphate
  modified_base (13)..(13): 2'-O-methyluridine-5'-phosphate
  modified_base (16)..(16): 2'-O-methylcytidine-5'-phosphate
  modified_base (18)..(18): 2'-O-methyluridine-5'-phosphate
  modified_base (21)..(21): thymidine 5'-phosphorothioate
gaaacgggacucuagcauatn

SEQ ID NO: 1426 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methyluridine-5'-phosphate
  modified_base (6)..(6): 2'-O-methyluridine-5'-phosphate
  modified_base (21)..(21): thymidine 5'-phosphorothioate
uaugcuagagucccguuuctn

SEQ ID NO: 1427 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): 2'-O-methylcytidine-5'-phosphate
  modified_base (5)..(7): 2'-O-methyluridine-5'-phosphate
  modified_base (9)..(9): 2'-O-methyluridine-5'-phosphate
  modified_base (11)..(11): 2'-O-methylcytidine-5'-phosphate
  modified_base (14)..(14): 2'-O-methylcytidine-5'-phosphate
  modified_base (17)..(17): 2'-O-methyluridine-5'-phosphate
  modified_base (19)..(19): 2'-O-methylcytidine-5'-phosphate
  modified_base (21)..(21): thymidine 5'-phosphorothioate
agacuuugugcgacaaugctn

SEQ ID NO: 1428 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methylcytidine-5'-phosphate
  modified_base (10)..(10): 2'-O-methylcytidine-5'-phosphate
  modified_base (12)..(12): 2'-O-methylcytidine-5'-phosphate
  modified_base (21)..(21): thymidine 5'-phosphorothioate
gcauugucgcacaaagucutn

SEQ ID NO: 1429 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): 2'-O-methylcytidine-5'-phosphate
  modified_base (4)..(6): 2'-O-methyluridine-5'-phosphate
  modified_base (8)..(8): 2'-O-methyluridine-5'-phosphate
  modified_base (10)..(10): 2'-O-methylcytidine-5'-phosphate
  modified_base (13)..(13): 2'-O-methylcytidine-5'-phosphate
  modified_base (16)..(16): 2'-O-methyluridine-5'-phosphate
  modified_base (18)..(18): 2'-O-methylcytidine-5'-phosphate
  modified_base (19)..(19): 2'-O-methyluridine-5'-phosphate
  modified_base (21)..(21): thymidine 5'-phosphorothioate
gacuuugugcgacaaugcutn

SEQ ID NO: 1430 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): 2'-O-methylcytidine-5'-phosphate
  modified_base (11)..(11): 2'-O-methylcytidine-5'-phosphate
  modified_base (13)..(13): 2'-O-methylcytidine-5'-phosphate
  modified_base (21)..(21): thymidine 5'-phosphorothioate
agcauugucgcacaaaguctn

SEQ ID NO: 1431 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methyluridine-5'-phosphate
  modified_base (2)..(2): 2'-O-methylcytidine-5'-phosphate
  modified_base (3)..(3): 2'-O-methyluridine-5'-phosphate
  modified_base (5)..(5): 2'-O-methyluridine-5'-phosphate
  modified_base (10)..(11): 2'-O-methyluridine-5'-phosphate
  modified_base (12)..(13): 2'-O-methylcytidine-5'-phosphate
  modified_base (14)..(16): 2'-O-methyluridine-5'-phosphate
  modified_base (17)..(17): 2'-O-methylcytidine-5'-phosphate
  modified_base (19)..(19): 2'-O-methyluridine-5'-phosphate
  modified_base (21)..(21): thymidine 5'-phosphorothioate
ucuaugggauuccuuucgutn

SEQ ID NO: 1432 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): 2'-O-methylcytidine-5'-phosphate
  modified_base (16)..(16): 2'-O-methyluridine-5'-phosphate
  modified_base (21)..(21): thymidine 5'-phosphorothioate
acgaaaggaaucccauagatn

SEQ ID NO: 1433 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methylcytidine-5'-phosphate
  modified_base (2)..(2): 2'-O-methyluridine-5'-phosphate
  modified_base (4)..(4): 2'-O-methyluridine-5'-phosphate
  modified_base (9)..(10): 2'-O-methyluridine-5'-phosphate
  modified_base (11)..(12): 2'-O-methylcytidine-5'-phosphate
  modified_base (13)..(15): 2'-O-methyluridine-5'-phosphate
  modified_base (16)..(16): 2'-O-methylcytidine-5'-phosphate
  modified_base (18)..(18): 2'-O-methyluridine-5'-phosphate
  modified_base (19)..(19): 2'-O-methylcytidine-5'-phosphate
  modified_base (21)..(21): thymidine 5'-phosphorothioate
cuaugggauuccuuucguctn

SEQ ID NO: 1434 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): 2'-O-methylcytidine-5'-phosphate
  modified_base (17)..(17): 2'-O-methyluridine-5'-phosphate
  modified_base (21)..(21): thymidine 5'-phosphorothioate
gacgaaaggaaucccauagtn

SEQ ID NO: 1435 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methyluridine-5'-phosphate
  modified_base (4)..(4): 2'-O-methyluridine-5'-phosphate
  modified_base (8)..(8): 2'-O-methyluridine-5'-phosphate
  modified_base (12)..(13): 2'-O-methyluridine-5'-phosphate
  modified_base (14)..(14): 2'-O-methylcytidine-5'-phosphate
  modified_base (18)..(19): 2'-O-methylcytidine-5'-phosphate
  modified_base (21)..(21): thymidine 5'-phosphorothioate
auguggauggauucgaacctn

SEQ ID NO: 1436 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): 2'-O-methylcytidine-5'-phosphate
  modified_base (15)..(15): 2'-O-methylcytidine-5'-phosphate
  modified_base (17)..(17): 2'-O-methylcytidine-5'-phosphate
  modified_base (21)..(21): thymidine 5'-phosphorothioate
gguucgaauccauccacautn

SEQ ID NO: 1437 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methyluridine-5'-phosphate
  modified_base (3)..(3): 2'-O-methyluridine-5'-phosphate
  modified_base (7)..(7): 2'-O-methyluridine-5'-phosphate
  modified_base (11)..(12): 2'-O-methyluridine-5'-phosphate
  modified_base (13)..(13): 2'-O-methylcytidine-5'-phosphate
  modified_base (17)..(18): 2'-O-methylcytidine-5'-phosphate
  modified_base (21)..(21): thymidine 5'-phosphorothioate
uguggauggauucgaaccgtn

SEQ ID NO: 1438 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (12)..(12): 2'-O-methylcytidine-5'-phosphate
  modified_base (16)..(16): 2'-O-methylcytidine-5'-phosphate
  modified_base (18)..(18): 2'-O-methylcytidine-5'-phosphate
  modified_base (21)..(21): thymidine 5'-phosphorothioate
cgguucgaauccauccacatn

SEQ ID NO: 1439 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methyluridine-5'-phosphate
  modified_base (6)..(6): 2'-O-methyluridine-5'-phosphate
  modified_base (10)..(11): 2'-O-methyluridine-5'-phosphate
  modified_base (12)..(12): 2'-O-methylcytidine-5'-phosphate
  modified_base (16)..(17): 2'-O-methylcytidine-5'-phosphate
  modified_base (21)..(21): thymidine 5'-phosphorothioate
guggauggauucgaaccgatn

SEQ ID NO: 1440 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (13)..(13): 2'-O-methylcytidine-5'-phosphate
  modified_base (17)..(17): 2'-O-methylcytidine-5'-phosphate
  modified_base (21)..(21): thymidine 5'-phosphorothioate
ucgguucgaauccauccactn

SEQ ID NO: 1441 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methyluridine-5'-phosphate
  modified_base (5)..(5): 2'-O-methyluridine-5'-phosphate
  modified_base (9)..(10): 2'-O-methyluridine-5'-phosphate
  modified_base (11)..(11): 2'-O-methylcytidine-5'-phosphate
  modified_base (15)..(16): 2'-O-methylcytidine-5'-phosphate
  modified_base (21)..(21): thymidine 5'-phosphorothioate
uggauggauucgaaccgaatn

SEQ ID NO: 1442 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (14)..(14): 2'-O-methylcytidine-5'-phosphate
  modified_base (18)..(18): 2'-O-methylcytidine-5'-phosphate
  modified_base (21)..(21): thymidine 5'-phosphorothioate
uucgguucgaauccauccatn

SEQ ID NO: 1443 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (4)..(4): 2'-O-methyluridine-5'-phosphate
  modified_base (8)..(9): 2'-O-methyluridine-5'-phosphate
  modified_base (10)..(10): 2'-O-methylcytidine-5'-phosphate
  modified_base (14)..(15): 2'-O-methylcytidine-5'-phosphate
  modified_base (19)..(19): 2'-O-methylcytidine-5'-phosphate
  modified_base (21)..(21): thymidine 5'-phosphorothioate
ggauggauucgaaccgaactn

SEQ ID NO: 1444 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (15)..(15): 2'-O-methylcytidine-5'-phosphate
  modified_base (21)..(21): thymidine 5'-phosphorothioate
guucgguucgaauccaucctn

SEQ ID NO: 1445 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (3)..(3): 2'-O-methyluridine-5'-phosphate
  modified_base (7)..(8): 2'-O-methyluridine-5'-phosphate
  modified_base (9)..(9): 2'-O-methylcytidine-5'-phosphate
  modified_base (13)..(14): 2'-O-methylcytidine-5'-phosphate
  modified_base (18)..(18): 2'-O-methylcytidine-5'-phosphate
  modified_base (21)..(21): thymidine 5'-phosphorothioate
gauggauucgaaccgaacgtn

SEQ ID NO: 1446 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (16)..(16): 2'-O-methylcytidine-5'-phosphate
  modified_base (21)..(21): thymidine 5'-phosphorothioate
cguucgguucgaauccauctn

SEQ ID NO: 1447 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methyluridine-5'-phosphate
  modified_base (6)..(7): 2'-O-methyluridine-5'-phosphate
  modified_base (8)..(8): 2'-O-methylcytidine-5'-phosphate
  modified_base (12)..(13): 2'-O-methylcytidine-5'-phosphate
  modified_base (17)..(17): 2'-O-methylcytidine-5'-phosphate
  modified_base (21)..(21): thymidine 5'-phosphorothioate
auggauucgaaccgaacggtn

SEQ ID NO: 1448 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (17)..(17): 2'-O-methylcytidine-5'-phosphate
  modified_base (21)..(21): thymidine 5'-phosphorothioate
ccguucgguucgaauccautn

SEQ ID NO: 1449 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (1)..(1): 2'-O-methyluridine-5'-phosphate
  modified_base (5)..(6): 2'-O-methyluridine-5'-phosphate
  modified_base (7)..(7): 2'-O-methylcytidine-5'-phosphate
  modified_base (11)..(12): 2'-O-methylcytidine-5'-phosphate
  modified_base (16)..(16): 2'-O-methylcytidine-5'-phosphate
  modified_base (19)..(19): 2'-O-methylcytidine-5'-phosphate
  modified_base (21)..(21): thymidine 5'-phosphorothioate
uggauucgaaccgaacggctn

SEQ ID NO: 1450 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (18)..(18): 2'-O-methylcytidine-5'-phosphate
  modified_base (21)..(21): thymidine 5'-phosphorothioate
gccguucgguucgaauccatn

SEQ ID NO: 1451 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (2)..(2): 2'-O-methyluridine-5'-phosphate
  modified_base (3)..(3): 2'-O-methylcytidine-5'-phosphate
  modified_base (4)..(4): 2'-O-methyluridine-5'-phosphate
  modified_base (5)..(6): 2'-O-methylcytidine-5'-phosphate
  modified_base (8)..(8): 2'-O-methylcytidine-5'-phosphate
  modified_base (11)..(11): 2'-O-methylcytidine-5'-phosphate
  modified_base (12)..(12): 2'-O-methyluridine-5'-phosphate
  modified_base (13)..(13): 2'-O-methylcytidine-5'-phosphate
  modified_base (21)..(21): thymidine 5'-phosphorothioate
aucuccacaacucgaggggtn

SEQ ID NO: 1452 - DNA, 21 bp, Artificial Sequence
  Description of Artificial Sequence: Synthetic exemplary iRNA agents for targeting influenza virus
  Description of Combined DNA/RNA Molecule: Synthetic exemplary iRNA agents for targeting influenza virus
  modified_base (11)..(11): 2'-O-methyluridine-5'-phosphate
  modified_base (13)..(13): 2'-O-methyluridine-5'-phosphate
  modified_base (21)..(21): thymidine 5'-phosphorothioate
ccccucgaguuguggagautn

SEQ ID NO: 1453 - DNA, 982 bp, Influenza A virus
  (A/parakeet/Chiba/1/97(H9N2)
atgagtcttctaaccgaggtcgaaacgtacgttctctctatcatcccgtcaggccccctcaaagccgagatcgcgcagagacttgaagatgtctttgcagagaagaacacagatctcgaggctctcatggaatggctaaagacaagaccaatcctgtcacctctgactaaggggattttagggtttgtgttcacgctcaccgtgcccagtgagcgaggactgcagcgtagacgctttgtccagaatgccctaaatgggaatggagacccaaacaacatggacagggcagttaaactatacaagaagctgaagagggaaataacattccatggggctaaggaagttgcactcagttactctgctggtgcacttgccagttgcatgggtctcatatacaaccggatgggaacagtgaccacagaagtggctcttggcctagtgtgtgccacttgtgagcagattgcagattcacaacatcggtcccacaggcagatggcgactaccaccaacccactaatcagacatgagaacagaatggtgctggccagcactacagctaaggctatggagcagatggctggatcaagtgagcaggcagcggaagccatggaagtcgcaagtcaggctaggcagatggtgcaggcaatgaggacaattgggactcatcctagctccagtgcaggtctaaaagataatcttcttgaaaatttgcaggcctaccagaaacgaatgggggtgcagatgcagcgattcaagtgatcctctcgttgttgcagcaagtatcattgggatcttgcacttgatattgtggattcttgatcgtcttttcttcaaatgcatttatcgtcgccttaaatacggtttgaaaagagggccttctacggaaggagtacctgagtctatgagggaagagtatcgacaggaacagcagagtgctgtggatgttgacgatggtcattttgtcaacatagagctggagtaa

SEQ ID NO: 1454 - DNA, 1521 bp, Influenza A virus
  (A/goose/Guangdong/3/1997(H5N1))
ctcactgagtgacatcaaaatcatggcgtctcaaggcaccaaacgatcttatgaacagatggaaactggtggagaacgccagaatgctactgagatcagagcatctgttggaagaatggttggtggagttgggaggttttatatacagatgtgcactgaactcaaactcagcgactatgaaggaaggctgattcagaacagcataacaatagagagaatggttgtctctgcatttgatgaaaggaggaacaaatacctggaagaacatcccagtgcggggaaggacccaaagaaaactggaggtccaatctaccgaagaagagacgggaaatgggtgagagagctgattctgtatgacaaagaggagatcaggagaatttggcgtcaagcgaacaatggagaagatgcaactgctggtctcactcacctgatgatctggcattccaatctaaatgatgccacataccagagaacaagagctctcgtgcgtactgggatggaccctagaatgtgctctctgatgcaaggatcaactctcccgaggagatctggagctgctggtgcggcagtaaagggagtcggaactatggtgatggaactaattcggatgataaagcgagggattaacgatcggaatttctggagaggtgaaaatgggcgaagaacaaggattgcatatgagagaatgtgcaacattctcaaagggaaattccaaacagcagcacaaagagcaatgatggatcaggtacgggaaagcagaaatcctgggaatgctgagatcgaagatctcatatttctggcacggtctgcactcatcctgagaggatcagtggcccacaagtcctgcttgcctgcttgtgtgtacgggcttgccgtggccagtggatatgactttgagagagaagggtactctctggtcgggattgatcctttccgtctgctgcaaaacagccaggtctttagtctaattagaccaaatgagaatccagcacataaaagtcaattggtgtggatggcatgccattctgcagcatttgaagatctgagagtctcaagcttcatcagagggacaagagtggccccaaggggacaactatctactagaggagtacaaattgcttcaaatgagaacatggaaacaatggactccagcactcttgaactgagaagcagatattgggctataaggaccaggagtggaggaaacaccaaccagcagagagcatctgcaggacaaatcagtgtgcagcctactttctcggtacagagaaatcttcccttcgaaagagcgaccattatggcggcattcacagggaatacagagggcagaacatctgacatgaggactgaaatcataaggatgatggaaagctccagaccagaagatgtgtctttccaggggcggggagtcttcgagctctcggacgaaaaggcaacgaacccgatcgtgccttcctttgacatgagtaatgaaggatcttatttcttcggagacaatgcagaggagtatgacaattgaag

SEQ ID NO: 1455 - DNA, 2153 bp, Influenza A virus
  (A/duck/Guangxi/35/2001(H5N1))
atggaagactttgtgcgacaatgcttcaatccaatgattgtcgagcttgcggaaaaggcaatgaaagaatatggggaagatccgaaaatcgaaacgaacaaatttgcagcaatatgcacacacttagaagtctgtttcatgtattcagattttcactttattgatgaacggggcgaatcaataattgtagaatctggcgatccgaatgcattattgaaacaccgatttgaaataattgaaggaagagaccgaacaatggcctggacagtggtgaatagtatctgcaacaccacaggagttgagaaacctaaatttctcccagatttgtatgactacaaagagaaccgattcattgaaattggagtgacacggagggaagttcatatatactatctagagaaagccaacaagataaaatccgagaagacacacattcacatattctcattcactggggaggaaatggccaccaaagcggactacacccttgatgaagagagcagggcaagaatcaaaaccaggctgttcaccataaggcaggaaatggccagtaggggtctatgggattcctttcgtcagtccgagagaggcgaagagacaattgaagaaagatttgaaatcacaggaaccatgcgcaggcttgccgaccaaagtctcccaccgaacttctccagccttgaaaactttagagcctatgtggatggattcgaaccgaacggctgcattgagggcaagctttctcaaatgtcaaaagaagtgaacgccagaattgagccatttctgaagacaacaccacgccctctcagattacctgatgggcctccctgctctcagcggtcgaagttcttgctgatggatgcccttaaattaagcatcgaagacccgagtcatgagggggaggggataccgctatatgatgcaatcaaatgcatgaaaacatttttcggctggaaagagcccaacatcgtaaaaccacatgaaaaaggcataaaccccaattacctcctggcttggaagcaagtgctggcagaactccaagatattgaaaatgaggagaaaatcccaaaaacaaagaacatgaagaaaacaagccaattgaagtgggcactcggtgagaacatggcaccagagaaagtagactttgaggattgcaaagatgttagcgatctaagacagtatgacagtgatgaaccagagcctagatcactagcaagctggatccagagtgaattcaacaaggcatgtgaattgacagattcgagttggattgaacttgatgaaataggggaagacgttgctccaattgagcacattgcaagtatgagaaggaactatttcacagcggaagtatcccattgcagggccactgaatacataatgaagggggtgtacataaacacagctctgttgaatgcatcctgtgcagccatggatgactttcaactgattccaatgataagcaaatgcagaaccaaagaaggaagacggaaaactaacctgtatggattcattataaaaggaagatcccatttgaggaatgataccgatgtggtaaactttgtgagtatggaattctctcttactgacccgaggctggagccacacaagtgggaaaagtactgtgttctcgagataggagacatgctcctacggactgcaataggccaagtttcaaggcccatgttcctgtatgtgagaaccaatggaacctccaagatcaaaatgaaatggggaatggagatgaggcgatgccttcttcaatcccttcaacagattgagagcatgattgaggccgagtcttctgtcaaagagaaagacatgaccaaagaattctttgaaaacaaatcagaaacatggccaattggagagtcacccaaaggagtggaggaaggctccatcgggaaggtgtgcagaaccttactggcgaaatctgtgttcaacagtctatatgcatctccacaactcgaggggttttcagctgaatcaagaaaattgcttctcattgttcaggcacttagggacaacctggaacctgggaccttcgatcttggagggctatatgaagcaattgaggagtgcctgattaatgatccctgggttttgcttaatgcgtcttggttcaactccttcctcacacatgcactgaaatagtt

SEQ ID NO: 1456 - DNA, 2274 bp, Influenza A virus
  (A/chicken/Yamaguchi/7/2004(H5N)
atggatgtcaatccgactttacttttcttgaaagtaccagtgcaaaatgctataagtaccacattcccttatactggagaccctccatacagccatggaacagggacaggatacaccatggacacagtcaacagaacacaccaatattcagaaaaggggaagtggacaacaaacacagagactggagcaccccaactcaacccgattgatggaccactacctgaggataatgagccctgtgggtatgcacaaacagattgtgtattggaagcaatggctttccttgaagaatcccacccagggatctttgaaaactcgtgtcttgaaacgatggaaattgttcaacaaacaagagtggataaactgacccaaggtcgccagacctatgactggacattgaatagaaaccaaccggctgcaactgctttggccaacactatagaaatcttcagatcgaacggtctaacagccaatgaatcgggacggctaatagatttcctcaaggatgtgatggaatcaatggataaggaagaaatggagataacaacacatttccagagaaagagaagagtgagggacaacatgaccaagaaaatggtcacacaaagaacaatagggaagaaaaaacaaaggctgaacaaaaagagctacctgataagagcactgacactgaacacaatgacaaaagatgcagaaagaggcaaattgaagaggcgagcaattgcaacacccggaatgcaaatcagaggattcgtgtactttgttgaaacactagcgaggagtatctgtgagaaacttgagcaatctggactcccagtcggagggaatgagaagaaggctaaattggcaaacgtcgtgaggaagatgatgactaactcacaagatactgaactctcctttacaattactggagacaataccaaatggaatgagaatcagaatcctaggatgtttctggcaatgataacgtacatcacaaggaaccagccagaatggtttcggaatgtcttaagcattgcccctataatgttctcaaacaaaatggcgagattaggaaaaggatacatgttcgaaagtaagagcatgaagttacgaacacaaataccagcagaaatgcttgcaaacattgatctcaaatacttcaatgaattaacgaaaaagaaaattgagaaaataagacctctattaatagatggtacagcctcattgagccctggaatgatgatgggcatgttcaacatgctgagtacagtcctaggagtctcaatcctgaatcttggacagaaaaggtacaccaaaaccacatattggtgggacggactccaatcctctgatgatttcgctctcatcgtaaatgcaccgaatcatgagggaatacaagcaggagtggataggttttataggacttgtaaactagttggaatcaatatgagcaagaagaagtcttacataaatcggacagggacatttgaattcacgagctttttctaccgctatggatttgtagccaatttcagtatggagctgcccagttttggagtgtctggaattaatgaatcggccgacatgagcattggtgttacagtgataaagaacaatatgataaacaacgaccttgggccagcaacagctcagatggctcttcagctattcatcaaggactacagatacacataccgatgccacagaggggatacgcaaatccaaacgaggagatcattcgagctgaagaagctgtgggagcaaacccgttcaaaggcaggactgttggtttcagatggaggaccaaatctatacaatatccgaaatctccatattcctgaggtctgcttaaaatgggaattgatggatgaagattaccagggcagactgtgtaatcctctgaatccgttcgtcagccataaggaaattgaatctgtcaacaatgctgtagtaatgccagctcatggcccggccaaaagcgtggaatatgatgccgttgcaactacacattcatggattcctaaaaggaatcgttccattctcaatacgagtcaaaggggaattcttgaggatgaacagatgtaccagaagtgctgcaatctattcgagaaattcttccccagcagttcatatcggaggccagttggaatttccagcatggtggaggccatggtgtctagggcccgaattgacgcacgaattgatttcgagtctggaaggattaagaaagaagagtttgctgagatcatgaagatctgttccaccattgaagagctcagacggcaaaaatag

SEQ ID NO: 1457 - DNA, 2280 bp, Influenza A virus
  (A/Duck/Hong Kong/2986.1/2000(H)
atggagagaataaaagaattaagagatctaatgtcgcagtctcgcactcgcgagatactaacaaaaaccactgtggaccatatggccataatcaagaaatacacatcaggaagacaagagaagaaccctgctctcagaatgaaatggatgatggcaatgaaatatccaatcacagcagacaagagaataatagagatgattcctgaaaggaatgaacaagggcagacgctttggagcaagacaaatgatgctggatcggacagggtgatggtgtctcccctagctgtaacttggtggaataggaatgggccgacgacaagtgcagtctattatccaaaggtttacaaaacatactttgagaaggttgaaaggttaaaacatggaaccttcggtcccgttcatttccgaaaccaaattaaaatacgccgccgagttgatataaatcctggccatgcagatctcaatgctaaagaagcacaagatgtcatcatggaggtcgttttcccaaatgaagtgggagctagaatattgacatcagagtcgcaattgacaataacgaaagaaaagaaagaagagctccaggattgtaagattgctcctttaatggttgcatacatgttggaaagggaactggtccgcaaaaccagattcctaccggtagcaggcggaacaagcagtgtgtacattgaggtattgcatttgactcaagggacctgctgggaacagatgtacactccaggcggagaagtgagaaatgacgatgttatccagagtatgatcatcgctgccagaaacattgttaggagagcaacggtatcagcggatccactggcatcactgctggagatgtgtcacagcacacaaattggtgggataaggatggtggacatccttaggcaaaatccaactgaggaacaagctgtggatatatgcaaagcagcaatgggtttgaggatcagttcatcctttagctttggaggcttcactttcaaaagaacaagtggaacatccgtcaagaaggaagaggaagtgcttacaggcaacctccaaacattgaaaataagagtacatgaggggtatgaggaattcacaatggttgggcggagggcaacagctatcctgaggaaagcaactagaaggctgattcagttgatagtaagtggaagagacgaacaatcaatcgctgaggcaatcattgtagcaatggtgttctcacaggaggattgcatgataaaggcagtccgaggcgatctgaatttcgtaaacagagcaaaccaaagattaaaccccatgcatcaactcctgagacattttcaaaaggatgcaaaagtgctatttcagaattggggaattgaacccattgataatgtcatggggatgatcggaatattacctgacatgactcccagcacagaaatgtcactgagaggagtaagagttagtaaaatgggagtggatgaatattccagcactgagagagtagttgtaagtattgaccgtttcttaagggttcgagatcagcgggggaacgtactcttatctcccgaagaggtcagcgaaacacagggaacagagaaattggcaataacatattcatcatcaatgatgtgggaaatcaacggtcctgagtcagtgcttgttaacacctatcaatggatcatcagaaactgggagactgtgaagattcaatggtctcaagaccccacgatgctgtacaataagatggagtttgaaccgttccaatccttggtacctaaagctgccagaggtcaatacagtggatttgtgagaacactattccaacaaatgcgtgacgtactggggacatttgatactgtccagataataaagctgctaccatttgcagcagccccaccggagcagagcagaatgcagttttcttctctaactgtgaatgtgagaggctcaggaatgagaatacttgtaaggggcaattcccctgtgttcaactacaataaggcaaccaaaaggcttaccgttcttggaaaggacgcaggtgcattaacagaggatccagatgagggaacagccggagtggaatctgcagtactgaggggattcctaattctaggcaaggaggacaaaagatatggaccagcattgagcatcaatgaactgagcaatcttgcgaaaggggagaaagctaatgtgctgatagggcaaggagacgtggtgttggtaatgaaacggaaacgggactctagcatacttactgacagccagacagcgaccaaaagaattcggatggccatcaattag

We claim:

1. A method of enhancing gene expression of an influenza gene in cell culture comprising,
   - (a) contacting a cell culture selected from MDCK cells and Vero cells with an siRNA molecule, wherein the cells of said cell culture have been engineered to express a recombinant influenza target gene;
   - (b) measuring the level of gene expression of said recombinant influenza target gene; and
   - (c) comparing the level of expression determined in step (b) to the level of expression in mock-treated cells, wherein an increased level of expression over mock-treated cells is evidence that enhanced gene expression of an influenza gene has occurred.

2. The method of claim 1 wherein recombinant influenza target gene is at least 80% homologous to a consensus sequence of the MP gene (SEQ ID NO: 1453).

3. The method of claim 2 wherein recombinant influenza target gene is the MP gene (SEQ ID NO: 1453).

4. The method of claim 3 wherein the siRNA molecule targets the first 500 nucleotides of said recombinant influenza target gene.

5. the method of claim 4 wherein the siRNA molecule comprises a sense strand 15 to 30 nucleotides in length and an antisense strand 15 to 30 nucleotides in length.

6. The method of claim 1 wherein the cell culture is selected from MDCK cells and Vero cells.

7. The method of claim 1 wherein measuring is performed via an ELISA assay.

8. The method of claim 5 wherein the sense strand comprises at least 15 contiguous nucleotides that differ by no more than 1, 2, or 3 nucleotides from the sense strand sequence of SEQ ID NO. 23, and wherein the antisense strand comprises at least 15 contiguous nucleotides that differ by no more than 1, 2, or 3 nucleotides from the antisense sequences of SEQ ID NO 24.

9. The method of claim 8 wherein the siRNA molecule increases the expression of said recombinant influenza target gene by more than 10%, 20%, 30%, 40%, 50%, or 60%, in either MDCK cells or Vero cells compared to mock-treated cells.

10. The method of claim 8 wherein the siRNA molecule increases the expression of said recombinant influenza target gene by more than 5%, 10%, 15%, 20%, or 30%, in both MDCK cells and Vero cells compared to mock-treated cells.

11. The method of claim 8 wherein the antisense siRNA strand is 15 to 30 nucleotides in length and the duplex region of the siRNA molecule is 15 to 30 nucleotide pairs in length.

12. The method of claim 11 wherein the siRNA molecule comprises a modification that causes the siRNA molecule to have increased stability in a biological sample.

13. The method of claim 12 wherein the siRNA molecule comprises a phosphorothioate or a 2'-modified nucleotide.

14. The method of claim 11 wherein the siRNA molecule comprises a 5' phosphate group.

15. The method of claim 12 wherein the siRNA molecule comprises a nucleotide overhang having 1 to 4 unpaired nucleotides.

16. The method of claim 15 wherein the siRNA molecule has 2 or 3 unpaired nucleotides.

17. The method of claim 11 wherein the siRNA molecule comprises at least one 1 non-natural nucleobase.

18. The method of claim 17 wherein said non-natural nucleobase is a universal base.

19. The method of claim 18 wherein the siRNA molecule consists of at least 3 universal base modifications.

* * * * *